United States Patent 11,718,879 (NON-CODING RNAS (NCRNA) FOR THE DIAGNOSIS OF COGNITIVE DISORDERS) - sequence listing, part 2

SEQ ID NO: 593 - DNA, 7349 bp, Homo sapiens
acagccattttacaactctatctgtgaaaagcacagaacgtattttgaccttttcaccgtgggatcctgaaggggacttaaagaacagccttcaggtcctgctggtcccttcctgggaagacttttattccctcggagctaagaaagacacctagatggtgccttcctctctcttgtgctgcttggaaggcatgggctttggggtcagctagaccctgggctagctcttggttatgttcccaacacctctgagaccttgggcaactgacttattgttcttggacatggctttctttgaaaaccataaaacttatagaatgggatgggagcattttaaaatacatttatgggaaattaacacagaagaccttgtttaaacattatttttagtggtcagccaatggcttcagcttaggaatgactgaggcaaaagcactaattaaggatggtaattttattcatctttgtatctgtttagtgtcaagttgtaggaagagagggtttaaaatatgagctagtaacccccccacaccccgagactctttaaaactatgaataaagttaagaaaactgtgcaagaactaagagaaggtcaaaggaaaagaagcgatggacattgtaggttcgaagcacaccaggcaccttccaggagaggagaaagttcaggaatgtggccctccctgcactgcaaatccctttgtggccccttcaagcctctaagctcttttacctcagctcatcattaatgctgatctccccaggtaggggagaggaggtggacttaggaggcttaactacattgcttaggattgtatatttcagagacactgactgatgtgagtcacacaattatagttctgagtcctcctctgttcttgagtatagagattggagaggaaagctgtgtttgtgattttagagtgcccgggtcaggcacttcctttttgtatgtgttttgggcaagccccttaccttttggagcctaacttaccacccctgggaagtgagggaactgaacttagtgctctctaaggccctgtttgagtttgcatgccattgactctggacttttctaaataaacaagtaaacttacagttaccatggagaatgtctgtgtccttgctgatcattgtaaatgtccctgatgtcaaaatgcaggatgataaaaagtgaagttgaaaaatgaggaaggagtgtgacagggagtgatcttaatcgttttgcagggtgtgcactttttaggctgcctaagggcagaattgaaatatatgccttctgccagcatatttcagagtcagccgaactacattttggttaggaactaccttgtccagaaagagaggggatgataatcaaagcaagggcagtcccagagctcagatgatccctttttcctggtgaaggatatccttggatggttgattttctattgagcctttaaaagagaacgctaggcttaacaaagggtcaagagtccacagctgaggaggccgagaggagccagggaaaggaagtggtttaaaagacttactgctattatattagtaataaattttttcgaatttattattgaaatttatatatatatttcaaaaatataccaaaatagagtgaagtgtatgatggatctctacattcctatcaagagtcaaccatcaattcatggccaatctagtctaacctgtatcttcatttaatcttgttttaacaaaattcttttgagacaaatcttgttcaatttcatctgcaaatatttccaaaggtatttctaaaattaagggcctttttaatttaaaaggcaaatgcaataatgttaaaacatctaaaaattaacaaaaaatttttaattgtattcactagcaagtcaatgtttaaatttctccaattgcctcatatacatatttttttaaaaatttgtctgaatctcgatcctaataaggtccatagaaagctattggggaatatgtgtcttaagtctcttttactctacaggtttccttccatctttctttctttctttctttctttctttctttctttctttctttctttctttcttgtgaagaaactaggccattttttcctgtgaattttctgattttgatgattaaatttctgtgttatcttttgatatgttcctcagtcttttctatttcctgtaaattgatatctaaatgtatgattagattcaatgagttttttttggcaaatatatttcatacatgtgtcatgtattctattaggagacaaacaatgcttgatagtctcttttttgtggtatcagtagccattattaatcattgtccagatcccttaattcattagaggctgcaatacaatatattcattctatgaatataattccttttaatctagtagttgtaatatttctagaagaaacttttcctgtttgattacactgaggaaatatatgttcattatattatctgtatgtaaaacccaggctaaatactggatttaacccctcatttccagtttcagcctattttgcagccttcttcagaagtgaccaatgatagctgtgtgtgttttaaattgtatttttttgaatgcatggacttaaaaatatttagcctggaaattttcgagtcagatgaatataggtttgagctctggccctgcctgttacctcagagagtctttccctttcttctcatggctaaagcctagtcactttgggctctcatgggtcttctgtagggaagctttccttaactttcctgagaagggcaaatgaatctctctgagactcagttttctcatctataaaataggggccatactactgatgccatctgacatagttgtgaagattaagtgagatagtgagtacagaaccatccattataggcattcaaagttctccacttttattgttattttgtatctaacaactttggacacttaactcctgtggtgaattgttttgctattatctctatcttgaaagtattgttggagaaacaatcatgaaaaaatatttttctacttctgtttatgaagatgcaaagtcacatggcaaattatcaatattttttatgaagatgcaaagtcacatggcaaattatcaatatctaaaatgttctgaaaggtggaagagaaagaaacagtattcaagagtcttgtcccaaggtgttgtgggggagacaaggtaataattgagaactatatataaaaataagtacaaagaattatatgaagcaattaaatctgatgggctggatggacttacttacgttagggaagggtgtctaggtacattggattcaaaagcggaggaagaaactactttggaggagtctttgtgagtggaagggaaatcctgaagttagggttggtctccttctcaaaaaaaggaagttgttgctttaggagggttgactaaataccctgacaatactcacttgactaaaaatatctcttccatgggcttgaagtcctaaagccagaaccagaagcgtagcttgttcctgctgcacaccgttctgtgttccacctccggaatcttgcccaggcttatccttcctcgggaatgtccttcttgtttgccttcttcacctgcttactcccacttattttacacgatgccaggagtcagggctttagagggtctttctcagtcccttcctttactgcaccattggggtagggcctcagtgacgttttcccatcttatcctgtacacgttcccatcacagcattcatcatactgctcatatccactgacttctctggactccaagcaccacaagggtagagactctcttaatcttctctgtaacctcagcacagtggccagcacatatgtgtgcttaagaaataataaatacaataaatttgtagctgggtgcagtggctcttgcctataatcccagcactttgggatactgaggcaggaggagtgcttgagctcagaagtttgagagcagcctgggcaacatagcaggaccccatctctactaaaaataaaaaaaaatcagctaggcattgtggcccgtgcctgtagtcccagctacttgggaggctgaggcaggaggatcacttgagtccaggagttgaaggctgcagtgatctatgattgtgacactgtactccccctgggcagcagagggagaccctgtctaaaaaaagaaagaaagaaagaaagaaagaataaatgggtgattgaagttttacccgtttatttgtaaatttaaatttggacaagttacccggaagtgtagaccagtaatgtgttaacacatgaacctaaatgagttatctggttgactcctttataggagcaggaacagggtggtggtgagttagcatgggccagcaagctggtttgggggcaggtaggcagaacaggctggctttcagtcctggctgaggcaggtttgaaagagcaaaggtgaatggcctggattgtattattcttattcttgttttcctagtactgcccttgggtgaaaagtgggagaaagtaagaagtgtttagggaacagcaattagccttttggattttcttggctagattgtggaaactgagcagatgcaaaccatatagaggttagatgggcctggatgattgctggggagctttggaaacacagccatgtgacaaggttacatgtagacatgtccatcttaggaatgcatagtagtctgtccaagaaaaagccatttgatattagtggggtgttttgtatatttgcacagaaaacttgctcatttatcgttcttaaagcactcagttatttgcctaaggaagatgccttttcacataaacaacggtctacctggtatcagaatttctcaacagataagacacccttgtgctcaggaagtaacttctgcaggcagatagcataccaaacttttattgttaatatgggaagaaaggcatgcatcagaataacaggaaaacctgctcttgtgtgtttgcacctgaggagggggaggggacaccatttttatcaggcacactaaaagcagccgttcattcttgcaagatggactgttctagattttgttgctttatgaaatttttggtacacaatttaagtaagtttttggcacaatttaagtaaaacccaggattatttcagacagttagaaatgaacaatagcatgtttatcattagaatcggactctccttgttatatttcatagggtttagcacttgtctgttaatacccatctcactaaatgtctccattcataacataggttttcttcccctgggtgaagggatggggaggagtgaatctttttctaatttctttttcttccatcatgtttatatgtataaaatttcacagaccaacattttctagaacctctgtattcgcggaacaagttcctttaaatacaaagatttctaagtgacattttgacttctgatttacatgaatcttagtaagttatgccaaataaactcttaaattatactgagtaagaagtctgattaagaagtttttcttctcaaaaggaaaataaatgttttcaattctttttaaaataagtttttgtgtttggcagtgccttggtctcacagcagtaaagagattaagtaaaatgctaacttgtagtaactctatatttttaaatttcttatcctaaaaactaatacagagataattcctgagaaacctcatttccctggcaagtcaatagcttactttgcttcttgttatttgcttttaacagtgacagggatttttattctttttttttccttttctttaatttgcagagtcaattaaactgcttaaccaaatagatcttaatagtgttgatagattcttattatattcctgtcataattattttttaaaactggcaggaagccttcagtattcaacatcatttacgacctcagtgaatggtcatgtaaatggacaatttgcagaaattccagctggggttaaccttagaacagggttgttccaatataaagctgctggcttcctttacattattatggatttctgtttgttttctttttatttttgggcaggcttcccctgagaagtttagatggacgatttaagggaggtgtgtttttaggaggacttagtggtgatattggaaaaatcttagtgaaatgacagccgaggtcattataacatggccttgagtctcataactcgggaggaagtaggtaggaggtggtggcagaaaggcaaagatactgaggtgtttctaacacgggcacaggaatatgaggcaataatagaacattactaaagttctcctctagaatgagtcattgacaaatataatttgaggctttaggcagccccaagaaaatatcaatttctatgatttttataaacttacactttggaaaggttggcaaattgatagacaatgaataaacgcatttagaattcaaagttgacattcatattatggcctcaatttagctaggtgagatatttagtgacacttggatgtctttccaagggtcagatttgttaaaacattatgctaaaacaatttgagagataactttaagtattctaggcttaactagaaagcaaattttgcattacagttcaggagtagatagtaactttgcaaacccaaatcaagaaatctaaccacattaaagaaatggattttgttgtaaaactaaaatgattacatactatatttcttaacttaatgagggagaaatgtacctctggtctaataagctccatattgttaaatgtcagtgttagcatctctcttcatcagtgttatccaaaatttaatgctaatattattttactgaatctgtgaagagattgtactatttttcttttctttctttctatttttggaggttggggtgtgtggagggatggtgtttcaaagtttggtgttgagattgtatgtatttccaaagagtaatactgaaataggttgtgaaattataaccagagttctacatcctcaactctttatattcaagaagttttgccatttcaaagaaagatgagaagttttaaaaaaaaaaattatgacaggactgtagtaagagtctatcaacactattaatatctatttgggtaaacagagaggcagataccttttcccacatgaactattttttgatcagtataaagtatgataaaatatgaaaaaaagcaaaattcaggatacttttgtaggtagacacgtcagatattatataaaattagcttaaatattcaaacactgtaaaatgagaggcagataggatatcgtctccaaagaggacatggtgaaaacgatactttgaaatgataaatagtcaaatatgggcataactttttcatattagagaaaacttattgcctagacaaatgtagtagt

SEQ ID NO: 594 - DNA, 5416 bp, Homo sapiens
atccacagcgctgtgttcaaggaactcttattttacatggttataacccccaaccacaagaggagtgatgctgacaattcggatctgcctaagaaaagccataaagtccttcctttaagtgaaaagtgaaagttctcgacttaataaggaaggaaaaaaataacttcatgctgaggttgctaagatctatgataagaaggaatcttctatctgtgaaattgtgaagaaggaaaaagaaatttgtgctagttttgctgctgcaaaagctactgccacagtgcacggaaatgcctcttgaatgggagaagctgctgctcccccaaattgctggggaagaaagggagttcctgatctttcttattgaggctcatggagcttctgtcctggagattcagtatacttcagtaatggctctggagaagagaactcaggatcctcaagacccaatggctcgtgatgataaaagcctttgggtctaccgacattttccctacgtgctcagacatgtctgcatgcatttattggcatatttttccatactcaaagcaagttgctatgtgttagtactaaagcaacccataatagtaaaaacgaatttctgcaccaagagaatgaatcggcagctgagaaagtcagagtgaagaggccccagtaatatctctacctacttgaaggttaaatattcctaagactctaggaggaaagaggagagaaagtgggccctgttctttcctccaggatgtaaggtttttccaggctgctttgaaaagtctcaattactccaggctatagaagaatacaatcagaggtgagttccctgaaatcaaggacactgccttatctaatggtgctgggagtgcagcgaacttgctggggacagtttgaaggatcatcttaagctctgaaaccaggttgctgccacctgctacagatcacccacagccaatgtccttggctgagtgacacagcttccccgtgaccgccactgatccagccaccaagtatgcagcccaacctatgaagctgagcccagaagtggctcaaaaaaacaagccacaacccagaactgaatcacaacagccttttcctttaacactatacttgctctatttaacctccgccatggccaattcaatagattcacagaaaatatcagcaggacgccttggttctcaacaccaagtctggaaagctgggtttacacgccccacctgagcaagcctgatcggtgattgtgttgggctcattcctcacttggccccttcaagcagagataggccctgcaagaactctctctaggaattgttttctcaatattttaaaatccacttttcctatatcctatcaatgggcacggagtgagagtgatacaggcatgtggaatttcacaaggctagatgtgccagcttcaagactactgagctttaggtatacacttgttatggtttggatttgtgtccccacctaaatctcatgtcgaatcgtaatctccaaagttggagaagggccctggtgggagatgattggatcaggggggcagatttcccctttcctgttctcatgatagtgagtgagttctcatgagatccggttgtttaaaagggtgtagcacctcccccttctctctcttccccctgctctggccatgtaagacgtgcctgcttccccttcaccttccaccatgattgtaagtttcctgaggcctccccagccatgcttcctgtatagcctacaatagagtaagccaattcaacctcttttatttataaattacccagtctcaggtatttctttataacagtgcaagaatggactaatacaacaacaccgaaacacacatgccagccagtattcaccctgtcctgtcctcaacatggtgacctaccagtatcactccttccaagcccatttccattgctccttcatgttcttctttgcctcttgagtaaacaagtcaaatctatccattcatatccccacgtattcacttgcttatccaacattttctgagcaccttctctgtccaagccactggccaggtgctatgggggttggggggctcagagatgactctcagagcaggagagagccctgctaactcatctccctccccatctgctccctgcataaccagcattttggaagctcagacctcgctacacccttagccctagccacaatgacctggatgaaccaaaatcaaattcttcaatagggaaagatttagagaccttgtcctcttagagaaggtaaaagcaatgttcctaaaatcaacagtatggtgtttcagttagaaaaataaaagttcaggttagccaaatattgctgggtaccaggaaatctgtgcaggcagagaaattgtctgccgtgcctgtgccaagataatcttctgtccaatcttctgggaggtcagggcgggccaatgcactgactcaccagggagggctttctaagaaagaaggctggccaggaatcttctagggggaaatatgctgtttttattgtgtctggtctccccagctccctcctaaatctgttgaatgagggagttcatctgctgggtgtttgagagctcaaactgtccaacattgtagtaaacatcaggcaaagggcagtaaacagaggctccctgtcccagctgggaggagcccagatattgatgagcacagcggacagccacagacacacagaaacacaaaaacaagtgccaggagcagtggctcacgcctgtaatcccagcactttgggaggccaaggcgggcagatcacctgaggtcaggagttcgaaaccagcctgacccacatggtgaaaccccgtctttactaaaactacaaaaaatagccgggcgtggtagctggtgcctgtaatcccagctactcgagaggctgaggcaagagaatcacttgaacctgggaggcagaggttgcagtaagctgagatcacaccactgcactccagcctgggcgacaacagcaaaactctgtctcaaacaaacaaacaacagcaacaacaacaacaacaacaaaaaaccaagcaaacacatgcagggctgcccataacctctggaaagaaagaactctcctggtcaggaatctcctcttgggcatgagtgtgaaaataaggactcttgaatttgcttgccacatcagaggcagcattgcagggaggcctttacttcagaggcagcattgcagggaggcctttacatacgtatgtcatccagcctcatggcaaaatagataatagattgtattaccctcattttctccaggggaaacctgaggctcagaggtcatcttgcctacagtgactatttgcaggactgaggttggtatacaggtctgtctgacttctccttgtaggctttcccagaaatcaaagcctcacacgaccccctcctctaaggcatgacagaacccagttgtctgttcaggcagggggaaggagggggtggcccacctgggggatttcaggggtgctgccacctggaaagtaaccctcaggagctcaccagcagtgcctggaactcagaccaaaatcactctcttgggtgtttaaattgtaaatatgtttacctgtattcaatctcaccctgtttattgtttgcttctcctcagtccacaaagcattcaacactcaccattctaaaaataataaaactgggctgggtgcagtggctcatgcctgtaatcccagcactttgggaggctgaggcaggtggatctcctaaggtcaggcgttcgagaccagcctgtccaacataaagaaaccctatctctactgaaaatacaaaattagccgggcgtggtgacacatgcctgtaatcccacctactggggaggctgaggcaagagaattgcttgaacccaggaggcagaggttgcagtgagtcgagatcccgccattgcattccaggctaggcaacaagagtgaaactctgtctcaaaaaacataaataaataataaataataataataaaactggctaggcatgatggcttatgcctgtaatctcagaattttgggaggctgaggcaggaagattgcttgagcccaggagttcaagactagcctggaaaacatagcaagatcccacctctacaaaaataaataaaaataaataaattagctgggtgtggttttgtgcgcctgtagtcccagctactggggaggctgaggtgggaagatcgcctgagtccaggagttcgaggcagcagtgagctgtgattgcaccactgctctccaacctgggcaacagagcacaaccatgtctcttaaataataatgacaataataaaaccaaaaacttttcacacctctgcctgcccctctatttatatttacaatcttacctttgatgttccaactctttggaaaagtgggatcacagcaccactgcattttcttatcctcctataacaagttctggagttgctaaaacaacgtattcctaaggtgcctagtaggtgacttctaattgtcacctgtaatggtatctttcagtcttctgcttacataactgttctgtggcattcagtatctacaggccaccatttccttgaacagtcttctttctcaccttctgacaaattcgtttgttcttatttatttatagcattttgatgattccccatcttctttacctgcatgctagactgatctccaatttgcaatccatcccttcttctgtttctccctctttacctccctctcagccaaagatctctctttagaaaccatcacccaaggtagaggaatgaatctctatgctttgacacctccttctattcctcttttcctcactctccacattcattcctacaaagtctttttttgtttttgtttttgtttttgagacagagtctcactctgttgcccaggctggagtgcagtggcatgatcttggctcactgcaacctccacctccagggttcaagcgattctcgtgcctcagcctcccaagtagctgggactacaggaacccgccactacgcttagctaatttttgtatttttagtagagatggggtttccccatgtgagtcaggctggtctggaactcctgacctcaagtgattcacccatcttggcctcccaaagtgctgggattacaggcatgagccactgagcccagccacaaagtcttataaattctgccttttaaaattcatcctgccgcctccattagatctgctcatgcccccttttaggtcacttttaagtagaaggctcctagctggtcttcctgctcacaatatttccccaacctccacatggctgtcaaagagatgttttagaagaacaaatacagcaaatacagccacgttaagacataaatgcaagtctgtctgactcctccttacttactgtaagttcaggtctgaatgcttcctggctagtgtgtaagcctcttttt

SEQ ID NO: 595 - DNA, 5499 bp, Homo sapiens
atccacagcgctgtgttcaaggaactcttattttacatggttataacccccaaccacaagaggagtgatgctgacaattcggatctgcctaagaaaagccataaagtccttcctttaagtgaaaagtgaaagttctcgacttaataaggaaggaaaaaaataacttcatgctgaggttgctaagatctatgataagaaggaatcttctatctgtgaaattgtgaagaaggaaaaagaaatttgtgctagttttgctgctgcaaaagctactgccacagtgcacgatttttaaagaccagatctcccaaagagtgaatctgccagagaataaaatctcatcggcaggagaacaagaacagcatacctggaaatgcctcttgaatgggagaagctgctgctcccccaaattgctggggaagaaagggagttcctgatctttcttattgaggctcatggagcttctgtcctggagattcagtatacttcagtaatggctctggagaagagaactcaggatcctcaagacccaatggctcgtgatgataaaagcctttgggtctaccgacattttccctacgtgctcagacatgtctgcatgcatttattggcatatttttccatactcaaagcaagttgctatgtgttagtactaaagcaacccataatagtaaaaacgaatttctgcaccaagagaatgaatcggcagctgagaaagtcagagtgaagaggccccagtaatatctctacctacttgaaggttaaatattcctaagactctaggaggaaagaggagagaaagtgggccctgttctttcctccaggatgtaaggtttttccaggctgctttgaaaagtctcaattactccaggctatagaagaatacaatcagaggtgagttccctgaaatcaaggacactgccttatctaatggtgctgggagtgcagcgaacttgctggggacagtttgaaggatcatcttaagctctgaaaccaggttgctgccacctgctacagatcacccacagccaatgtccttggctgagtgacacagcttccccgtgaccgccactgatccagccaccaagtatgcagcccaacctatgaagctgagcccagaagtggctcaaaaaaacaagccacaacccagaactgaatcacaacagccttttcctttaacactatacttgctctatttaacctccgccatggccaattcaatagattcacagaaaatatcagcaggacgccttggttctcaacaccaagtctggaaagctgggtttacacgccccacctgagcaagcctgatcggtgattgtgttgggctcattcctcacttggccccttcaagcagagataggccctgcaagaactctctctaggaattgttttctcaatattttaaaatccacttttcctatatcctatcaatgggcacggagtgagagtgatacaggcatgtggaatttcacaaggctagatgtgccagcttcaagactactgagctttaggtatacacttgttatggtttggatttgtgtccccacctaaatctcatgtcgaatcgtaatctccaaagttggagaagggccctggtgggagatgattggatcaggggggcagatttcccctttcctgttctcatgatagtgagtgagttctcatgagatccggttgtttaaaagggtgtagcacctcccccttctctctcttccccctgctctggccatgtaagacgtgcctgcttccccttcaccttccaccatgattgtaagtttcctgaggcctccccagccatgcttcctgtatagcctacaatagagtaagccaattcaacctcttttatttataaattacccagtctcaggtatttctttataacagtgcaagaatggactaatacaacaacaccgaaacacacatgccagccagtattcaccctgtcctgtcctcaacatggtgacctaccagtatcactccttccaagcccatttccattgctccttcatgttcttctttgcctcttgagtaaacaagtcaaatctatccattcatatccccacgtattcacttgcttatccaacattttctgagcaccttctctgtccaagccactggccaggtgctatgggggttggggggctcagagatgactctcagagcaggagagagccctgctaactcatctccctccccatctgctccctgcataaccagcattttggaagctcagacctcgctacacccttagccctagccacaatgacctggatgaaccaaaatcaaattcttcaatagggaaagatttagagaccttgtcctcttagagaaggtaaaagcaatgttcctaaaatcaacagtatggtgtttcagttagaaaaataaaagttcaggttagccaaatattgctgggtaccaggaaatctgtgcaggcagagaaattgtctgccgtgcctgtgccaagataatcttctgtccaatcttctgggaggtcagggcgggccaatgcactgactcaccagggagggctttctaagaaagaaggctggccaggaatcttctagggggaaatatgctgtttttattgtgtctggtctccccagctccctcctaaatctgttgaatgagggagttcatctgctgggtgtttgagagctcaaactgtccaacattgtagtaaacatcaggcaaagggcagtaaacagaggctccctgtcccagctgggaggagcccagatattgatgagcacagcggacagccacagacacacagaaacacaaaaacaagtgccaggagcagtggctcacgcctgtaatcccagcactttgggaggccaaggcgggcagatcacctgaggtcaggagttcgaaaccagcctgacccacatggtgaaaccccgtctttactaaaactacaaaaaatagccgggcgtggtagctggtgcctgtaatcccagctactcgagaggctgaggcaagagaatcacttgaacctgggaggcagaggttgcagtaagctgagatcacaccactgcactccagcctgggcgacaacagcaaaactctgtctcaaacaaacaaacaacagcaacaacaacaacaacaacaaaaaaccaagcaaacacatgcagggctgcccataacctctggaaagaaagaactctcctggtcaggaatctcctcttgggcatgagtgtgaaaataaggactcttgaatttgcttgccacatcagaggcagcattgcagggaggcctttacttcagaggcagcattgcagggaggcctttacatacgtatgtcatccagcctcatggcaaaatagataatagattgtattaccctcattttctccaggggaaacctgaggctcagaggtcatcttgcctacagtgactatttgcaggactgaggttggtatacaggtctgtctgacttctccttgtaggctttcccagaaatcaaagcctcacacgaccccctcctctaaggcatgacagaacccagttgtctgttcaggcagggggaaggagggggtggcccacctgggggatttcaggggtgctgccacctggaaagtaaccctcaggagctcaccagcagtgcctggaactcagaccaaaatcactctcttgggtgtttaaattgtaaatatgtttacctgtattcaatctcaccctgtttattgtttgcttctcctcagtccacaaagcattcaacactcaccattctaaaaataataaaactgggctgggtgcagtggctcatgcctgtaatcccagcactttgggaggctgaggcaggtggatctcctaaggtcaggcgttcgagaccagcctgtccaacataaagaaaccctatctctactgaaaatacaaaattagccgggcgtggtgacacatgcctgtaatcccacctactggggaggctgaggcaagagaattgcttgaacccaggaggcagaggttgcagtgagtcgagatcccgccattgcattccaggctaggcaacaagagtgaaactctgtctcaaaaaacataaataaataataaataataataataaaactggctaggcatgatggcttatgcctgtaatctcagaattttgggaggctgaggcaggaagattgcttgagcccaggagttcaagactagcctggaaaacatagcaagatcccacctctacaaaaataaataaaaataaataaattagctgggtgtggttttgtgcgcctgtagtcccagctactggggaggctgaggtgggaagatcgcctgagtccaggagttcgaggcagcagtgagctgtgattgcaccactgctctccaacctgggcaacagagcacaaccatgtctcttaaataataatgacaataataaaaccaaaaacttttcacacctctgcctgcccctctatttatatttacaatcttacctttgatgttccaactctttggaaaagtgggatcacagcaccactgcattttcttatcctcctataacaagttctggagttgctaaaacaacgtattcctaaggtgcctagtaggtgacttctaattgtcacctgtaatggtatctttcagtcttctgcttacataactgttctgtggcattcagtatctacaggccaccatttccttgaacagtcttctttctcaccttctgacaaattcgtttgttcttatttatttatagcattttgatgattccccatcttctttacctgcatgctagactgatctccaatttgcaatccatcccttcttctgtttctccctctttacctccctctcagccaaagatctctctttagaaaccatcacccaaggtagaggaatgaatctctatgctttgacacctccttctattcctcttttcctcactctccacattcattcctacaaagtctttttttgtttttgtttttgtttttgagacagagtctcactctgttgcccaggctggagtgcagtggcatgatcttggctcactgcaacctccacctccagggttcaagcgattctcgtgcctcagcctcccaagtagctgggactacaggaacccgccactacgcttagctaatttttgtatttttagtagagatggggtttccccatgtgagtcaggctggtctggaactcctgacctcaagtgattcacccatcttggcctcccaaagtgctgggattacaggcatgagccactgagcccagccacaaagtcttataaattctgccttttaaaattcatcctgccgcctccattagatctgctcatgcccccttttaggtcacttttaagtagaaggctcctagctggtcttcctgctcacaatatttccccaacctccacatggctgtcaaagagatgttttagaagaacaaatacagcaaatacagccacgttaagacataaatgcaagtctgtctgactcctccttacttactgtaagttcaggtctgaatgcttcctggctagtgtgtaagcctcttttt

SEQ ID NO: 596 - DNA, 1881 bp, Homo sapiens
gagattctggaattcctatgaaaatgggatctctaagaaagattcctaacaactggctttggagacgagtaagtgtgtattttcacctttaagtccatgagctgcagggagccacttcatgggaggattttgatgacattttactttgtgcatgctcattttaactgtatgacattaaaacagcaattacacatatcaaaagagagaacggatagcactggggaccaaaaggctcactttcccacaaatagtcccttcttctggatttcatgggtacccattagtaccagaatttcctgggtttggctatggaaagtttcaagtatatattacatatatattataagatgaggacaacttgaagccactacctgtcgtcagtgtgtaaggagggaggtagtttttcttgggagggtggaggtgggaggtagcccagggaaaggcatgaagggcaacaggctgggaggagggaggaagtgcagtcagccttggaaccttagacagactgagtgctgcatctgggcacaggcggtcagcctgcactgactcctgaaggcaaagcaagggaggggagaagcatgtggctaaacagagaaggggaggattctagccagaacacactgtttgcttttataaatgccaggggtggtgcattggtaagcaccctgcacagaagaatggggtgggagggctggaggaatacctggtccagtccatccaggagtcctcccatacctgcattccctgcccatgatgcgatttgatgctcagcctacatcaaataacactatgtgctgaatgggaaatgagaggaaaatacgaggaggccttattattcttcacaattttgcctatgtccaattccattcagcatgattgcttttggtgcccagagaagctgagtttctatcaaaaacatgtatatataggtgagtgtatctgtgtgtttgtacatgtatgtatatgtgtgtgtatacatgtatatataagtatatgaagatggtggtgttcctgctggcatcctatggccaacttgacttcagagtacccaggggaaggcctggctggccggatgcccttgcagatgtcagctccagtgtggacatggtgcaatgacagccaggggtgtgggagcatcctgaatgtgtcccgtgggagggcagggcctctgaaagggtcctactcaggatatgtctcctgaaagccaccagggggtggagagagaagtaggagcccaacaatggctccatccctgctctgcttttggcggttgtataacatccctgagtcccagattatttgtctatcaaaaggacaaatgaggtggctcatgcctgtaatcccatcactttgggaggccaaggtgggcagatcatttgaggccaggagttcgagaccagcctggccaacatggtgaaaccccatctctactaaaaatacagaaattagccaggtgtggtggtgcatacctgtaatcccagctactcaggaggctgaggcagaagaatctcttgaacttgggaggtggaggtttcagtgagccaagatcacaccactgcactccagcctgggcagcagagtaagactccatctaaaaaaaaaaagagataacaatatcccctttgcagaatggtgatgggcatcagacatgacatatgtaacatgtcccatgcacggaagggtgctccatgactgcaaacctggatgatgatgacaacgacgatggagatgactaagactgtatttaaaaatggaattgctgttgtttcctggcttcctgatggtcctgttttttaccttctgctgctttttacggatttattttttcttgactgattcgtacctttttgagcaatgggaacctttggtggtgtaaagcct

SEQ ID NO: 597 - DNA, 2352 bp, Homo sapiens
ttatgacctgggagctgggcccattttatgaccaaggagatggggagttggaatggtggtactaagaggcataggaagttgagtgtgaataccattggtgatgggtccaggagaactagactatggttcttgaatatctgtccacaaagaatatactaacttttgtcaacttctcagaactcccaactggagtcggtgagacctaggattttctgcacttccacacatgcctgttccaagtgtggctgtcagccagtcaacaagtttgtactatggcccattctctgatcaccaggattacaggaactcacacactcctcatacttggcctgtagtcctacttcttgttagaagtctccaagtctggccagtcacatgaccaagtgttgatttttctggaggaaaaattttatggaaatgatataggggaaaggtgggaggagatgaaagaacaggcaagagctgtcagggttaaatccaggcccgggcatgagaatggaagtgatcagggagactcggtccttgttccaagtctccaaagaagaccaaagtgggtcccttgagcaatgaagaatctgagataaattctcttcaagtatcatgtacaaaatctgtgagccagagattttgacttgagcaagccatggaaatgcatggagcaagggtgacactctgtggggagacagaagaatttcaactatttaatgtccattttgttgtttttaccctttcttatccaatagatggaatgcacatgaaatgaccatattaagcctctctctatttacatcccaggctcactgggatgtgatctactgcagttacattttcttgtaacggtttctggattagaccctagggaaagtgagtaaggagccagtttctgtttaacattctagttttactcattttaggaaggctgtgagtgaggcttgtctcctttaaagtttcttctccaatggaaaccaagaacagacaaaatttagagctcagctgtggtctcttctcatcttctgctcttttgctttgaccacagtttttctactcttcccatcaacactagagcaatggctgtgcaaataggaataggaaatactaccacaatgatagaaatattatccacactatcacgtagggaagaacaatatcctgaaagagaataaaacacgaataaggtgatgtacccacattaatctgtgggtttgtggaatgagggttgcaaagttattgggaaaaggaaagagcagagttcacccattcaaaaaaaaccttttgtctactaatctctagtgtaaagaaaatgtagttcagataccattcattgtcttgggtcatgcttagtgcccccaagaagacaaacatatttattcttgggattctgataggcttcaatatgcaaaggacaatggaaaagtttagacactctattttcaaaattttataaacttgttttattggggaaaatgtccaaattgctagacacattctaagttctgccttggagaatcctactttgtctgagattgaggcagaggaattgttatcctgggcattactcagctcaggaacatggagcctgtggttcatgccagtgtgtgtcttcatgcagtctctccacaagagcaacagtaagaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacac

SEQ ID NO: 598 - DNA, 1531 bp, Homo sapiens
acccaacatgctactcagcccaattcccaaccctttgcaccaggtttggcttctgtttttatttttgcaaagtctgttcctcttggctccaacttccgtctttggagttgttaatggagaagttagggtgctatgtagattcaccaggcgagttcagtactactaccctggggatgaatgttggtgagaagccattccagatagacccccaacaactctgcttcgttgaccctcagaacagtaccctgtgggactcctgagccgtaaggagtctccctggtagcgcgcagcggggccaggctctgtgctccggcccccgtgcggtgcccagctctgcaggttcccgaaagtgcgccccggggtggggttgcaatccgccccgtgacggcataataaataattagagggtttaagcgtgttagccacagctcatgctaatgagccagataagggctcacgctaacccgaagtgacagtttgcatataggagggaagaagaaaaaatcctgcttccccccccacgcacaaacttgattgctccttctcaaattcatgtccccaaatcccttcccccattcctcggacttccctcttctcacatgcccccacttcagccacaacacacacactatccgtttttgacccttcctttgcctttcaccgggtcagacggcattgtgacgtcacaaaacccctgggtgcctatatctgacctgcgcggaaagttcattctgagtgcgtcctggcgagtctcagcccccaagcgggtggaacgcaccaagggtctcatccgcgaggaagggctttaacgctcagggtcaggaacctctgagagctcttggggacttgcgcgcccttggatgctcttgcgttcaacagggctaggagactaccggctggggcgaggaatgcaggcgcctagagccttggagctcctgaaacgttcctgccgcctccggaaagcaagggcagtttaccgaagtgactgaggccaagtatttgcagcacgggcagggaccagtaactgattttcaggccttttgagaggaagaggaagagagaggaagagaaggatttctaatagtagatattcactctcatggactctttaggaaacagcaacaaagacaagattaagaacaccaaattgtgtgactatccacacaaaaaagcatcttcataagaaccaaaaatcagagggcaaggaaaaaggctgaatgcaaaaccagaatgtcaacagggtgctaacggagaccaatggaaggggcaactgactctccccagggaaggtaggcaaggagattgagggaagtagcaatgaaaggagagcttgcaaaatgaagtcatcagagctttgcataagaaacaattcatggaccttagatcaagtagtgaggattaaaactatgtctatgtgaggctttggctagtttttctacctaagacatccttacctctcctttccacttgggaatcatcttcctttcctaaccatcatcatcaaccctcaaggcagtcaggggcatctgtg

SEQ ID NO: 599 - DNA, 1759 bp, Homo sapiens
ttttttaaatttttttcagaatttcaacctttattttagatttagggggtatatgtacaggttggttacaagggtatattggtatattgggtgatgctgaggtttgggatagaaatgaatccatcactcaggtagtgagcatagtacccaatagttagtttttcaacccttcccctttccccactcctccttctagtagtttccagtgtttattgctgccatctttatgtccatgagtacccaatgtttagctcccacttataaatgagaacaagtggtatttggttttcggtttctgcattgacttgcataggataatggcctccagctgcatccatgttgctgcaaaggacataatgtcattctttttatggctgtatagtattccatggtgtatatgtaccacagtttctttatccagtccaccactgatgggaatctaggttgattccatgtctttgcgattgtgaacagtggtgcaatgaacatatgagtgcatgtgtctttttggtagccgtatttactttcctttgggtaatgagatttcagggacccagtaatgagattgccgggttcaatggtagttctgttttaaattctttgagaaatctttaaactgctttccacagtggatgagcgaaattacatttccaccaacagtgtataaatgtacccttttcaccacagccttggcagcatctgttgattttcgactttcttataatagccacctggctggtgtgaaatggtatctcattgtggttttgatttgcctttctctgatgattagtgatgatgagaattttttcatatatttgttggctacttttatgtctttttttgtgaagtctctgttcatatcttttgcctatttttaatgggattatttagtttttgtttgttgaattaagttccttatagattctgcagattagacctttatctaatgtatggcttaccaatattttctcccattctgtaggttatctgtttactctgttaatagtttcttttgctgtgcagaagctcttcagtttaattaggtcccacttgtcaattttcatttttgttgcaattggttttgaggacttagtcacgaattatttcacaaagcagatgggcagaatggtgttttctaggttttcttctaggaatcctatagtttgaagtcttacatttagatttttaatccatcttgagttaatttttttatgtggtaaaaggaaggggttcagttttattcttttttaaatatactttaagttctagggtatatgtgcacagcgtgcaggtttgttacatatgtatacatgtgccatgttggtgtgctgcaccaattaacttgtcatttacattaggtatatctcctaatgctatcccttgcccctccccccaccccacaacaggccccggtgtgtgatgttccccttcctgtgtccaagtgttctcattgttcaattcccacctatgagtgagaacatgcggtgtttggttttttgtccttgcgatagtttgctgagaatgatggtttccagcttcattcatgtacctacaaaggacatgaactcatccttttttatggctgcatagtattccatggtgtctacgtgccacatttccttaatccagtctatcattgatggacatttgggttggttccaagtctttgctattgtgaatagtgctgcaataaacatacgtgtgcatgtgtctttatggcagcatgacttacaatcctttgggtatatacccagtaatg

SEQ ID NO: 600 - DNA, 10568 bp, Homo sapiens
acagacaaacaggtactggcaagatagactatgctgatggagtaaccaagtttgtgagtatatgaaaataacgagggatgacatatgggaatattacacaatgataaagttggaatgtcacaatgaataaacaaaatctgattcagagactatgccaagccaggtgataagatcttgaagaaccaagatccagagagaagtgaaaggaatcagtgttccatggaacggaagtgcatcaggaaaggaaagagaaaacagattcagactaaagcacgtgcctgacaatgtgtctgctgcattgcatgaggcagccttgctgcagccaaccatagtggggtccaattaagaggcttaattgaagaattccaagttagcagactgtcctggcactcagaggatattgtgcctggtaatgatagtgttgaattggacagaaagaatattcacaaaggtggctgtccatatccatgggttctgtatccatagatgcagaattcttgaatacagagggttgactgggagatctgacatctgcaggttttggtatccgtggaaggttctgcaaccaatctctggtggatgtgagaggtgattgtacttaagcttcaagaaaggcctcctctgctaaaaatgctctctgattagccattcactgcttcctgaactatgaagacatcttctaggaatactcaggatcttctgctatgtggctttaatttattttaagattaattcctcattaccttcttacacaaagccaccattagcatatcaagcacagctgtacaaatttttaaaaggccaaaagatgtatctgccaattctaggaggatataaacctgaaggcacaaatctgggctggagcacatggtttcccttgtgagaagaaaaagtctccttcctctgaatggacacaccttgcacaccagggcacaaggtttgtctagaagagcacagctgaacatcataaagtgcagaaccacacacctggcatccttgtccctacacaagagaagccagaagttgcagctcaatgcaccatgaagctgagacagaaatggagatcccccagccccacctctctggaacaggaaagatgaatgaggaagaaacacagggcagtatggggaagagggtcatggcggacatgggggtagtgggctggtctccccaccttctcatattatgctaacagggacaaagacacattcagactcctttaaatagccttttcccattctgtttcaagatgggtgacaagagacatcagacacccaccctccccggtaaaagaagcaaaattataaatgcataatcatatctctaatagaacatctaggatggaacactagagaccaatgacaaagtcatggaaaacacccaagacacagaaggagaaaaaaagcaaggggccagcttggctgagattggctgggagcctgaaggggcttggtattgtgtgaaaagcctcagtgaaggagtttcagtggttcacatacccagtatggacttctgcaatctgaaccatgggaaaactcctttaacctaatgaactgtgacactagcatgggtggtgacttggagaccacacaaggccatagcatcagagaacttatacagggttactcaaccccttgccaagacctgagtgctgtggcaaggcaccacttggggagcacagccatcacaggactacatccagcccccttatctccacatcctagaagatcctgctgacatttcccagtgtccacctggaggactatagtggcattgcactggctagacccaaagatgttgcatgtccccaggactctagctcacagggattactacccactgttgaaaggacagtgcaacacacaaaaaaatggtagcccatgggacaagggaaaccaaagtatgtgcttcccagagtctgagaggtctctgtctgggactatgagaagttactctgccctcaacagttgcacaaactctgtgcccagttttataagcagagagtaaattctcctaccactggcagagcagcctctgcactaaggctcagaagtagagaagtagagactaggacttctccgcctcaaaacacccaactagtgtctctgccagatgctttagcaagtgagctggagggctgcctatttggggtgccacagagagcaggagctctgtgtcctgcagcatgtctggagttgtgggcagtaaccccacactgcagccaccacttaaatcagcctgcatcacttgggtccaagagggtcataccaccactagcactgctgtaacccacaccatgctggctgcccagggacctgagcaccagcccacccacttggcccaccaccgccatgactagaattcatgcaagccacctggaatcagcccactggtaaccaccaacacaagttctcctgtgcactgcctttgggcacaaagataggcatgctcaggccacctctgcaaccaccaggacctgaagactggaccacgtggcttcctagtccttagcacaaccttatcatagccttcaataataaccacactctaaccctctgaggaaatcacagaaagcactaatgctgtttacagctaagtacatcttacagagactgtaccagtacagacacccagaattaaagccaaagtgcttaatccaaccaacaccaccaatacatcttcagaaaaatgtcctctatgaaagtaaattcagaaacaagaatcaactgttacactagatatgcagatatcaatgtaaagacacagaaaacattttaaaaagcaaggaaatatgacacttccaaaagaacacaatgattctttagcagtaaattcttaacaaaaaaggaatttttgaaaaacaattcaaaatatgaatttttaagaagcccagtgagatataagagaattctgaaaaaaaatacaaataaatcatcaaaacgattcagtatatgaatgagaaatttaacaaagtgatagatatttttaaaagaaccaaatggaaactcttgaactaaagaattatttgaaggaaatacaaaatacacttgaaagattaaataatagactagatcaggcagaagaaagaatcccagaacttgaagacaggtcttttgaaataattttgacagacaaaaataaagaaaatagcttacaaagaatgagcaaagcctttctgacatttagaacaacataaagtaatttaatattacaattattgggatcactgagaatgaagagacaaaggaaggattagaaaacctatttaaggctggacatggtggctcatgcctgtaattccagcattttgggaggtcaaggcaagccgatcacgaggtcaagagatcaagatcattctgttcagcatggtgaaaccccatctctaaaaatacaaaaattacctgggtgtgagatgctgcatgcctgtagtccctgctactcaggaggctgaggcaggagaataacttgaaccccaggaggtggaggttacagtgagctgagagtgtaccactgcactccagcctggcaacaaagcaaggctctgtctcagaaaaaaaaaaagaaaaaaaagaaaacctatttaataaaatgatagatgaaagcttcccaagtttgcaaaagatttagaaattcagatagaggagtctcagcaatcttcaggaatatgcagtgcaaaggccttctccatgacacatgatagtcacactgcctaaagccaaagataaatagtgtatcctaacaagggcaagagaaaaatgtctaatcacccataatgaaaacctatcaaactaacagtgaatttttctgcagaaactttataggccagaaaagtatgagaggatatattcaaagtgctgacattaaaatcaaaacaaaaatcccagctagcaaagaatactagatccagcaaaattatccttcataaacaaaggagaaataaagtctttctggacaagcaaatgcagaaggaatttgttaacgctagactggccctacaagaaatgctcaagggagtcctaaacctggaagtgaaaggatgatatgtgccataatgaaaaaaatacaaaagtataaaacacactgataaagtaatcacacaaaggagaaaaagaaaggacactaatggtactactacagaagtctaccaaaccacaataacaatcaataagataaaaatgaaaggaccaaaaaatacatactacaactccaaaacaatgaacaatatgataggaaaaaagcctaacatatcaataataagcctgaacataaatgaattaaattatccacttaaaagatatagaatggcatatggattaaaaaacgtgatccaaacatgtgctgcctacaggaaactcatcctaccagtagaggcatgtgtagaccgaaagtaaagcaatggaaaaagttaccccatgtaaatacaaacaaaaagtgagcaagagtagctaaacttagatcagacaaaacagactgtaagttaaggacattagaaaaagacaaaggaagtcactatataataataaaagaatcaatctagtaagaggatctaattctaaatatatatgcacccaaaactgcagcatccagattcataaagcaaatattttatctaaaaagagaactaaactatgatacagtaatagcgggggattctaacaccccactgtcaacattagaaagatcatctagacagaaaataaacatagaaatatgggatttaaactggactttagaccaaatgttcctaacaaacatttacagaacatactatatacattcttttcatcaggacataaaatattctccaggataggccatatatttggccacaaaacaattctcaaaaaatttttaaaaaatcaaaatgatatcaaaaattgtctgagaccacaatggaatggaactagaaatcaataccaagaggaactttggaaactataaaaatacatagaatttaaataacatgatcctgaatgacctgggtcaacaaaaaatatgtaaatttaaaaaacttaaaacaaatgaaaattaaacacatacaaaaacccattgcatacagcaagagcagtactaagagggaagtttatagcaataaatgcctacatcaaaaaacaaaaagactacaaatttacatctaacaatgtgccttaaggagctagaaaacaagaaaaaaccaaacccaacattagctaggaaaaagaaataatacaaatcagagcagctgtaaatgaaatagaaactataaaaatataaaggatcaacaaaataaaaaggtgatttttcagaaagatacaactgataagttagtagctactaactagtctaatcaggaaaaagataagagaagacccaaataaagaatatgagaaatgaaaaggagacattaaaacagatatcacagaaatataaaatatcaccagactattatgatgaactaggatactgacaaactgaaaaacctataggaaatggattctttcttggagacataccacttaccaagattgaatcaggaagaaatgagaaacttgaacagagtagtgagagtcaataatgagtagtgagattcaatcactaataaaaagtctccaaacaaaaaaaaagtccagatgggttcatagccaaatactaccaaacatgcaaaaaagatgtaatgctaagcatccagaaactattccaaaaatgaaagaggaggaaattctccccaactcattctatgagaccagcatcaccctgaaaccaaaaccagacagtcacaataaaaaaagaaaatttcaggcaatatccctgatgaatatagatgtataaatccttgaaaaatattagcaaacacaatccaacagcacatcaaaaagataattgcctgaatagccaaagtaatcctgagcaaaaagaacaagctagatacattacattacccagcttaaaaatttattgaaagtctatagtaaccaaaatggcatggtactggtacaaaatagatatatataccaatgaaacagaataaaggacccagaaataaagccacatgctttacagtaaattgatcttcaacaaagctggcaaaaacttttaatagggaggggacaacctctttaataaattgtgcttggaaaattggatagcaacatctagaacaataaaactggacctgtctcttccatcatatacaaaaatcaactaaaagtggattaaagacttaaacataagacatgaaactacaaaaattctagaagaaaatttagggaaaagtcttctgattgttggtcttggtaaatacttttttcacagacctcacaagcacaggttacaaaaacaaaaatagaccaataggacaattcaactaagcatctgcagagcaaaggaaataatcaacagaattaagagataacctgttgaatgggagaaaatatttgcaaagtgctcatctaatagtggactgttatccagaatacacaaggagctcaatccaaaagaaaaaaataccacataataccattaaaatgtggacagagaatacaaatagatatttctcaaaagaagacatagaggtggtcaaaagttatataagaaatgctaaacatcactaatcatagaagaaaggcaaatcaaaaccacaatgaaatattctaccccagtcaggatggctattattaaaaagacaaaaaataactcatggtttggatacaaaggaaaggtaactcttactcactgtttggtgggaatgtaaactagtacagctacaatggaaaatagtatgaagatttctcaaaaatctaaaaatagaattaccatttgatccagcaaccccactactttgagtctactcaaaggaaaagaaattaatatatcaaaggcatacttgcactacttgcatgtttattgtagcactgttcgcaagagcaaagatatgaaatcaacctaagtgtccatgaatgaatgaagaaaatgtagtatatatatacacaatggaatactatttaaccataaaaataatgaaatcatgtcatttgcagcaacatggatggaaatagtgtctgtattagtttttacactgctataaagaaccgcccaagactgggtaatttacaaaaaaaaaaaaaagatttaatcgacccacagttttgcaaggccatatcattatcttaagttaaataagccagttaaataagccaggcacagaaatatatttcacattctcactcatatgtgggaactaaaaactttgatcacatggaggtagttactggaaagactataatagagactgggaagggtgagtgggggggagggagagaatgtaaagaagtgagttaaagtttatagacacacagtaagctagaagtaataaattcaatgtttgatagcagagtagggtgacaattcttaacaaaaatgtattgtactcaggtgctagataccctaaatgccctgacttgattatatacatgcaacaatttttagattgtataaatgggagaaagttcaaaagcacttcatgtatttgaaaaagcttttgccctatatattctcgtagtagttttacaatttctggttttacatttaggtttttaatccattttaagttgatttttgtatatggtgtgagatgagggtctaatttcattattttgcatgtaattattcagtttttccaacatacttttttgaagagactttttcccattgtatattcttggtgacttgttgaagatcaattgaacatatatgtttagatttatttctggactctccattttgttccacaggtgtatgtgtgtgtgtatatatatatatatctgttttgatgctagaactgtactgttcagattactacagctttgtagtatattttgaaatcaggtagtgtgatacctctagttgtgttcttcttgctcaagattgctttggttgtttggggtcttttgtcattccatattaattttagattttcttctgtttttttaagaaatgtgattggaattttgataggaatttcatggtaagtatcttgtatctttgggtaatatggacattttaacagtattaattctgatccatgaacacaggatacctttccatttatttgtgtcttcttcaacttctttttatcaatgtttactagttttcagtatatagatatttcatctccttgattaaatttattactatgtgttccatttattttgattttattgtgaaaatgactgcttgcttaattttttggtcacttggaattccagtaatatactaaatagaattggtaagaacaggtattttttttttttttttaatcttagagaaaaagctttcagcttgtcaacattgagtaggataatctttttaagatacagtgctggaacaactggacatccacatgtggaaagatgagtctagacacagaccttatgtcctttccaaaaattaactcaaattgaatcacagacttaaatgtaaaatgcgaagttggctgggcgcagtggctcacgcctgtaatcctggcactttgggaggccgaggcgggtggatcacgaggtcaggagtttgagaccagcttggccaacatgatgaaaccccgtctctgctaaaaaatacaaaaaattagctgggcgtggtggcgcgcggttgtagtcccagctacccaggtggctgaggcgggggaacagcttgaacccaggaggcagaggttgcagtgagccaagatcaagccactgcactccagcctgcggacggggcaagactccgtctcaaaaaaaaaaaaaaaaaaaagcaaagttgtaaaatggctggaagaaaacacaggacaatatttagatgatcttgggtttggagatgtcttttagacttttagaagctaatctaaaagaagctacacacggccgggtgctgtggctcacacctgtaatcgcagcactttgggatgctgaggcaggtggatcacctgaggtcaggagttcgaaaccagcctaaccaacatggtgaaaccccatctccactaaaaacacaaaaaattagccgggcgtggtgacacgcgcctgtagttccagctactccggaggctgaggcaatagaatggtgtgaacctgggaggcggagcttgcagtgagctgagatcacacgactgcactccagcctggtgacagagcaagactcggtctcaaaaaaacccaaacaaacaaaaagaagctacatattatatgattccaactatatggcatcccggaaaggcaaaattatggagatggtaaagagatcagtgattgctgggggctggggagaggaagaaatgaatacatggaacacagagggtttcagggtcagaaaaactactccttgtgtgatactataacggtggatacatgtcattatgtatttatccaaaccaatagaatgtacaacaccaagagtgaactctattgtaaactatagacattgggttatatcgttgtgtgctatggtctaaatgtttatccccaccaccactaaatttatatgttgaaatcctaaccttcaaggtgatagtgttagaagatgggaccttttcgaagtggagccctcgtgattgggattaacacccttatgacagagaccacagagggctggctagtccttctatactgccatgtgtgtacagtaaagagatgattgtcaatgaaccaagaagcgggccctcagcagacactaaatctgctgacaccttgattttgacttcccagtttccaaaactataagaaataaatttcttttttaataagctacacagtttatggtattttgttatagcagcctgaagagagtaaaaggatgtagaaatataggttcagtaaccataacaaaagtaccactctgtggaagatgttagtaatgtgagaggctatgaatgaggtggcgaggaggtggtatatgggaaatgtcactttgttctgttcagttttgctgtgaatctaaaactgttctaatagataaagttgaatacaatattaaaacaacaacatgttactgtctttgtaactattcaatgacatttaggcagggcagaggctattggacattatatatatccttaaagtctccctttatatatatacacacagatataaatatataagtatagataaagatgaagcctaaaaacctagtttaattatgttaaatttcattagggaatatgtaattttacctctcgcttttattataatggtcttgacttgagctggccatgcacattttcaccatgctgaatttaaaattgggctactttatagagttttgaacaaaatgctgattcccctcagactctttacaacattgctctgaatcatatgaattgcccttaatcaataaagcagcactcatttgactggccctgtaatgtgtaaccttctatttccaaatatggtaaacatagagaagccatctatgtgagaaggtttgagtaggctttactcccatttaccctagtattgatttctatatatggcaggaaggaggaaaagggatgttttcatcccttctcagttcctatccctaaatttttatcttaccaagaactcaaatgctgtttcctt

SEQ ID NO: 601 - DNA, 3729 bp, Homo sapiens
gaggagcccgaagtcggcgcgccgagtgcggctgcgcgggccccgccgacggagcccgcggccgggaccccgaacccccgcctcgagcccgccgcgccggggctctctcaccggaacgcgagtccccgcggggccaccggcgcgtggcggctgagcggccgcgtttggctcccggagcgcccacaccctctcgggcttccggctttctcccgaggcccggctgcgcctggcttgtggtagcatccgctgtggccaggctcggagctacactcaggaaaagtggagttaatggaggttcctagagacactcacacaattctcaatccacatttcaaaaggctcccctgagacgcaccctgtcggcccctttccgaaagcacgcgaacttaaggctggcaggtgctttaaaagacactcctcccaaggactaggaagcctctgaaatgggcttggaagtttctaatcccaaagacttcgaacccaggatctggatagcaagcaaaaatatttagatatttactcagttgaaaacgtggggggtggcttcgtggtctcttcgccagccaaatcgcgtggaaaaccacgacctcaatttttacaacagcacgaagacttacaagtgagcgtagcagcgacttcctggaacctcaaacaatgtgggacgctgcaataatgcctgagggcttttgacttacagttgccgccggagacctggggagggggtagtacttgggccggtgagtccagcctcaggaactgtcctttcaaaaatggtgatggatgtaacaagttgcatgtctgggctttatttcagtgtattaattgtgcgatcttttaaaatagctgtatttttaaaactgttttacagaaatctctttaaaatgtgattattctctatattcttaaagaatacaatggctaattaaatcctttgttgataactgactctcaaaccgatatcttggccatacgtttaagtcccagaggattgctgcggtgtatagaatccctactttggtgctctctttttttccctctttggaatgttctcatcacctcttctaaaatccttcactgcttttcatctcctcatctgcctctatccactctgatccttcctcttattctttctgctttactgtttatttttcattcttctctcctttctcggctggttttctctgcggctccaggtgaagattgatgggatgtttatgtccacagccagctaatgagaggtttcttttcttctggttgtaaatagggcagtggtatcttgagatattttcattgctcttcactatcagaagttctttccctgtgagagatgtttccttttcttaacttttggatttggccctcttcgagacagctggcaagttgatcttggaataattgaagtataactgtatattgtttcaaagtatgaggattttatcagagtgtgggcgaatggggtggcttccccatcttactgcccaactatgcttggtctgagactaagatagtggtttccaaacttaccgctaagctaatactttcctactctgcttcctactcaggagctttttgaaaatacagaatcctgcaatctaccccctcaagattctgattcctttgtccagggagaggccaagacatggcacttttaaaaactatatttaaaaaaatatgtttgggacatgcctacatgtaaaggcagagtaaagaagatcagctgtttttgaaggagattaacacataatttaagaatgttattgaagacctagagattgtagtcaataatatgcaatgcagtaaggtgaagtaaagtgaagaccaaggaatttatggcctttggagagaagaaaacccacacataaatgaccctagcatgtgcaccagtatgagttctctgggaacagagagagggtcaagaaattatgttggctttgaacaagttctcttctcaatgcttcactttttttttatcaataaaatgggagccattttcaatcctcatctttcttggcctctcaacaatactcaacactttgaccactattctttcttaaacatttcttcttcctttgacactgcattttcttggttttcctccttagtttcctaggcactgcttctctgattcctttgcatattcctgctggtctccctaactattaaatataacagtaccttaaaattcagttttagattcttttctgttttcattgtaatctcttggcctaagcagcatcacccacgccaatggctttagttatcatctatatgccagtgatctccacatatatgcctccagcccagacctttcctctaaattccaaatctgatccactagtcaaagtttgaccctacctctaaattccaagcttcactgacatggccacttaatatctcaaagttgcaaagtttagtccaactgagttcatgaacacttgttttccttatcccccatctctctagttattcaaatcaaatatctagtagtcagtaaccgctgatgtctccctcacctccattcttccattctccatatttgttgcagcactaactcctggcaattttatttctaaaatctaattggtctacttctttccaatcaccaccaatctaattcgatctcactgtatacaatctgggatcctccattcagtctccattttgcagccaaaattatcctctaagaaagcaaatgagactatgtcactactccaaaaatctccttaaacagtttctcattgctttaggataagtctagaattcttaaggcagcctaaaagaccatacgaggtctggccttacctgccttttccagcctcatctcacaccattttcaccttgtttcctgggcagacttcctggtcttcttttagtttctcaaaaatgctatgatcccaacaaccaaaggctctatgtacatgccattctctcctttagttatcctatctcttactcatccttcaggtctcagcttgaaagcgacatccttgggaaaaacatttctgacctcccagatacattcaagataccttgttatgtcagctctcttaccaccatataccctcccctcttatgacttaccacagcttgtaactacattttggtatgtgtaactactaggttaatgtctgttgctccccacattaggataaagaccatgtctatttgggcctgcacagtgcctggcacatagaagctacccaataaatatttcttgaatgattattgtcctatgagtttatttctgggattctagaaggttgttagatcgggaaattagatcactgatcattttcaagagagcaatcttctgtatgactagtgggaagaaatgcagaaatgtgctggaagacaattctctgtgggactctagtatttctgcatgtcttgtgagcagaggcactaacagcttttgttttagactatattttcaaggatttttttttttttttggtcaaactgccttggaaaatatacatagtgtcccctgccctgctccccctccccgccaagagcaggggcacatttgtttaccatccaatatagtgaagataatgtctttggaggtaaaggtcaagcaggttttcttgcagcctattataaaaagattggggatttcctaagcttagatagagtttctcagctgtgaggcaaacccactgcaggtgcatcactcacctgaaccacaccatgtagctccaggtaagacctgggggcaagggaactgac

SEQ ID NO: 602 - DNA, 3088 bp, Homo sapiens
aaatccttaatcatgccaaaacgccattctcctgcctcagcctcccgagtagctgggactacaggcgcccgccaccacgcccagctaattttttctatttttagtagagacggggtttcaccgtgttagccaggatggtctcgatctcctgacctcgtgatctgcccgcctcggtaaataacaaacattggcgaagatgtggagaaactgaaacccttatgcactgctggtgagaatgtccaatggtacagctgctgggtgtatatcattttttcttacgtgcttcaaatagtaacatatctattccctcaccctatgacaaatctcaatacaatgctgatgtcaatctttagtcttctcctctccaggccaaacaatcctagttttctcatggcagtgtcttgatcattcactaccctaagtctcctctgggtgctttctaatttactcctaatgttctttctaaaatgctcacctaaattctgtataatctggacaacacatggtacagtagaactattttttgcccatgctcttactgctgtatattactcttactgctggatattaccataaaacctaacattgtattaggcttcaattagagttcacatcagagtgttgcttcatatatttaaaagcacagattttatagcaattaattaaatgaacataatttaaaagagttgctgttaactataaacttagaaaagtctatacataaaaatctttatgaagaaattcatcctcagataccgtataacagcagaatgtgttatatactattatgactgtaattcacagcatacatatactatgtggcattgatataattatggtcacagaaaaggtatatttgttaatacttattttatttggatataaaaacttaataaacatgtaaatgaattcaacctttaattgccaaacctggcattaaagaacttgatatgaaatgaacacataacttcagaaaagagatcttgagtactaaaaatccaatgtgaacacactttagatttaagcatttgaatgactgaattcatttcaattgacacttaccttgaacatttagcaccctttctacattaacatcagataatctcttttttcgaagttcagcacgtattctaaacacttgatcagcatatggagtcaccacaccaatactgccatcatctaacttcccccacgctactggccacttccttcttaactcttctacacgttccaccacttcaaacacctttaaaaacaaacacacacatacatattaaagttatcaccaatgtttggagaaaataatatcgtaactaaaactgatttataaaggatcccattttagcagatgtcatttaaaaaaaaaaaaaaactacccctaaatgggagtaatgctttgctgatgtgaactgaatgagaatataaatttttcatttacattttaaacagtaaaattctccaataatacaaccagtgaaaacatgaaaatcagggacaatgctattggcccccaagttcctgtgtagggaggaacaagctcaagttcctgtgtgggaaaaagacaggccatgattctagggaaggcaagttctcacagccccagtaattctcagtccactctctccagatcaggccaatgaaactaaccaaccaactagaagcttcctgtcatcagtgacatcactaagtcccagcagtacaaggtctaacattgtccccttcctcactgatataactaagcagaccagccaacagccaccaattgacaacaaaccacagctgggactaggccacatttggatcacagagaaagactttcagaattcactgcctgctagtggtacaagtccagccaagccatttcattaaccttgcaataaagcaatgccacagtttatgcaactgaatttttcagaccccaattactggattatgatagggtttttaggatagtttgttctattttaattcaatgaattgatcaaacagtttcaatgtctggcacagtggagaaggtacaaaagttaataaaacatgttccttgcccgctacttactgagaagaacttatggtttatttagaaaagagagtcataataaaaaaaatatataaggcaagcacaaatagagggtcagtcaagagtccaggggcatacagaggaaggaggtgtgttttcaaatgtctttaagtacatcgtttctttattatttactaacagtatctattttaatttataatattaaatatatttaataaaaattgacaattttcatcctttgaaaaacttgaggttactgactacgaagcagttcccatgtccagatacaaattcagtgaactacagaggtaaggactacagtcatcctatcgttattatgatacagcagcaagtgtatcacatacacagactacccagggaaggtgaagagcaaactggactaaagacatggcattctcactatcaggaaacagagtagacatactcagtctactgcaataaggaataagaaaaagttatctttacccatgtggttagatgtggggatagatgagttgggagacacctctgctgcgccctcccaccccacagagttcccacctctaagcaacacacaaccatttctgcactttatcctcctgtcatgtagtcaaaaaacagacttagaatgatgatatgagtcattctgggaaacctctctcccagaaaaacatcttctaagctggtcaaaattagcaaagacaatcattcaaagtctctaaagacagatcaaagaggttacaagaaattgagaagcatccatctattcaacaaaacctgtaaaaactcactgagaacagtggaaggttgaggcctacaagctatggactgccccctttcccccacagctcttacagaactgttttaacggccaaggggcaattcccatcgccctagctccctcctattccaggtacttttggcagctggtaaacattggcagatttcatttttcacagctttgtgctgcagaaggcctatgataagcagttggtagtagtcaggtggtacccaacccccatctcctgctacatagggagtgggacagtg

SEQ ID NO: 603 - DNA, 2339 bp, Homo sapiens
gctgtcaataagacgtggacctgcgagccggggcaaaagggcttccggtctgcgggaaactggaggctagcggtgggcgtggaccgtcgaggtgactggcggttgtcggatctgctgttgtttgctgaccaggcagccgtaggtaatgacggatgcccagaccctgtgggcggagtaaaggaatcatgcactgatacacgcacactcaccgaggggcgcgtccgtctgcgtgcccctcatctcgtagccgaaaggagcgcgttccggggcaggcctccgggtacttcccgcagaggaccgggctttatactctttgctccttttcctcccctagtaagtcataacttattttgggagaagggcatagttatttgtctctcgtctccatgctacagcactttatgtgcttttcattcaaaatcgttcctcgaggacgaccaagtaatgtgatttgggggacagttttcataggaagggctttataagtttacaccaacataaagaaaacttaaaaaccttataaccgcttatttttcagaagtattatttttcatttaatctaaaaccatacttttagaacatgaaaccaagccaaacagatctttgcagattgtgcaagcgaacttttttttttgaatgaaagtggtgccatcaatgcaaaagcaagcccatataagtgccgaaaggtactcgtcataaggaggagttgcttccctattctgaatttttatttatttttatttatttatttatttgagacggagtctctctctgtcacccaggctggagtgcactggcatgatctcggctcactgcaacctctgcctcccgggttcaagtgattcttctgcctcagcctccccagtagctgggactacaggtacatgccaccatgtctgcctactttttgtatttttagtagagatggagtttcatcatattggccaggctggtctcaaactcctgacctcgtgattcgcccgcctcatcctcccaaagtgctgggattacaggcgtgagctgccccctgaatttgttttttttaagcaactctttttaaaaagagagaaaaaataatctctcttgagtgtattagttattgagctattccatttggaggtggcttaacccaaaacgtgtatggatgtggtaagattacaatggacttgaatgttctagatgaaatctgggccgagagtaattgcataatagttttccaaaggactgtcagatggtaaactcctttcatttactttgaactgataaacgataagatggatttttgttttttgacctttttatctacatttacttctgaaaattgaaaaagaatctgaattccaacaaaatgtttctaggcaagtatttgcatgatgcttctctaacatttcctatatcttagtgttttctctaatgttttctgtagctttcaaatttcactcctgtaagtttttacactaccagtaagaaagatctgggccaattatacagaatggacgatgatttttaaaagaatagagaaagcattcagaaaagagacaataatttgaaaatgttctgacatcatgtatttccttaaagcaatacaagtcctgtatgtccagttcatgtctactccaaccgagcttttttcagacacttagaaattgccttcaagaaaatccttatggaacattgtaacctagaggggcatttattttcgtttaaatatgtattaattgcaagtagtgacagaacctaaaaagcaaaaaccatatagcaccagttccaaggttcctatatctaatgcagttactcctactgcagtacaaggaggaatataaaatccctaggagaaatacaaaaggccattgtcttctttgaccagatttgaggaaagttttcatggaagatgtggtctttcagtgggcgttgagggtaaatatgcagatatggttagcctgtgcattctggtggaagctcagagttggaaaaacatgaaacagattgcagagtctggcatgtacaaagaggtatggtgagacatgtgagttctaaacatcaggctcatgaatttggactaaatttttgttatggaaacatggaaatcctaaattaattgatgccagaatataaattggttaagaacatcaagaaatcataacaactgagttattttgaagttggtgtaatgtggtcaatggaacgctggtgaatgatccttgaaacctggattgtattttagcactaagacagtatgcgtgtaatcacttgcaataaattcatttttttaggctttcttcttttcatctgtaaaatgagagattggtttagatgatttctgaggtcttttttatagg

SEQ ID NO: 604 - DNA, 1517 bp, Homo sapiens
tcaggtgtatatataaaatgaaaagcaaaatgtaagtctaagacacagaaaattttggaaagctaactttgatttcaaattcaacttcctaaatatgatttgggatttccttagtgggtgaataagggcaggcaattaaggtccattctcttacttttcaagagcttcagttctggtagtggggtgcctcggaggcagatagcaaaagtgtatgcattaaaacaagttttgtgtaaaggatttgttagacaaaaaaccaaatatttgtgggtgagttcttaatactaaataaagatagttgtatattgttttaaacaaatttagatttgccttttagatataatcacatgcattactataaattattttttccttttaatatagtcaggaaaaatccacagcatttagcaacagcatacctttggataaaactgcttatagttatatgtttcgtttcagcatcagtgagaaaatatacattattatgccaccgtttaaaatgctggtgctcctttattttatatagtgttttattgcttcatatgtggaatattaaaatcaccttaacagctagccggatgagataatcacactccacgctacagctccctgactacagctaaaaactctgcataaaatacggcaggtttgaaggtctctgcaagggctctgaaaagtggataagaataagaggacttacacgaaagccagaaatagaggggagactgagcagtacatttcctggggttttaatttatattttgtatataccaacaggctccagatcagtctaagctgcagagctttgaataggaacacaccaaaaaagctccagaaaaattcacttcctctggccagaagatgggagtggggtaggggtggggaggctacagaaaagcctttagactcttggccatctccatccaagtgtcagcaaagaactagcagccctcccctccctctcatgggggtggcgttggggatggcagcctcagtggggtgaagtttttgttatcttttactcttgcccccctcagctagaaagacaatctcagaccctgaggggtgaagcccatggtaactgtcagtccagaatcctctacctagcaaaattaaatctctcagaaatagagcaaactgggaaaattatcaagtgaaaactaaacaaattcatcactagtaggtctacttaaaggaaatactaaaggaagttctttgagtggaagggaaatggttaaaagggggaaccagctggctgtggtggctcatgcctgtaatcccagcactttgggaggcagaggcagactgagcacttgaggtcaggggtttgagaccagcctggccaacatggcaaaatcctgtctctatcaaaaatacaagaagttagccaggcctggtggtgcacacctgtaatcccagctacttgagagtcttaggcaggagaattgctttaaccagggggacagaggttgctgtgaaccaagatcacaccactgtactccagcctggaagacaga

SEQ ID NO: 605 - DNA, 14910 bp, Homo sapiens
acacctcggccggcgcagcgccccgagtagattacagcgcggcctttgtcgggcgggcctggctcccggccaggcgcccaaacaataaacaatcccccgggtgcgggcagggggtttcgccggccgcagccaggctctaggtgtgcgctggcgaatatctctatcaaccgcgaggagggaccgggccgggggcgcgggcgccgcggcgggcgctcttaccttccacccacagctcctccacgttggtctcgaggttcgctgcttttaatcccaccgcgaaggccccaaatatgaggaggcccacaaccaagaacttgccgcagtttttttgaatgtaacaacccagtttaaataagagtctctgaaacttcgctctcagccacagcggcgctttccggccagtagccttcccctggggacgaagcagaagggaggagtgagcgccggggagtcgcggcccgcgcgcccacgcccgcttgcgcgcacccgcccggtgagcccccaacagccgtgggggcgcgggtggccgcggcacacggactcgccctcgagactgcagccccggcggatctgagcgtcatggggggctcggtcataaagccgggccgcagcgtgggagctgcacctcggggacatcagggcgcccccacccgcgggatccctgagcgacttggggcactggggctgcaatacagaagaggaagccgaggtagagaggagagaaaccactcgacacagacaatattcaccccagagctgagaagggaggggctgcgtaatcccagcgatggagcccaaggttcaggagccagcaaaccagtcctgctctgtccatcaccctcggggacgggcgctaggggcgagcgctctttggaacaacatattgcgggttcccccaactggacccccgccgagaatggtagtaagtggggatccacgtggtgagcgcggccgccggagttcactcccgacgcatttccatagcgtggggagaggctgtgtgagctgaattaggaagtggggcagccagctgcaacttacgacaatatttgtgatcggaagagggcagccacatggatctttccctcctctcccttcctttctggttaaacgtaaaaaacagccgagtgcaaagggaagggctcaggccggcgcaggctgctccccggcgcggcatttccccggcgctggccgcggccccggcgggcccccgtctgggtgctcgccttccctggattccacacatttcagcgagcctcgtaaacacaatgaacccggcagctccgcagactcgcaccgcgaatttaaggtggcaatttgtttacaacttttcctcccccgaccaggccctaaggagaggcggctcaaaacctggaaaacgggggggatatctttttccgagaataattttttaagggagcagagatttcatgctcaacaaaaccaaaactggctgccaaaaaaggaaaccacctttatttcggctccctccccccttcctctctccgcctctctccactccgcctccccctccaagatgttaagaaatgtggcagccgtacaggagtttaggctgcaaataggggcaggggcgcaggaggaagaagttcagggcagggggcacggggcaggacagtgccgcggccgcccttgaggtggtccgccgtggacggctttccagtgctccggaaaaggcacaccagggagggcgtgtgtatacacacacacacacgcacacacacacacctccaccccctgcggacctcagacagccctttcctcccaggaccagagggagggtttgaatttttcaatccccatttgtctgctgcttttcctggagaggtgtgagtgagtgtgtgtgtgtgtgtgagagagagaggaagagagtgtgtgtgtttgtgtgtggcgggggcgatcccaaagagttagaggagggaagagaaagtgggaggagagagtctgaaatgcaccttggaaatctgctccagagcgaaggcggcgtcgcagtagctgggccggtgcagatagtcccggtccggcgcggcagcacggcgcagcccccccgtccgtctgcgcctcccgcctccagccggccgtcccggggcaccgatacagccgctgccgccgccgccgcggtcctggggctcggcggcgttaccagccgaggccatgttgccgccgccgccgccgccgccgcggggacggaggcttcccgggcggcccggcgcgctgctgccgctgctgcgggctcctggcgcgcctgggcgctcggcttgcgaggacgctgctggccgcaggctgctcgggctcgggctccggttgacagaccagccgctgctgctgctcacacggcgggcgctgctgccgctgcggccgcggccgctgccggggagtcagaccctgcgccttccattgccacattgcgcgggggtcccgaggtctctgcggccgccgctgcccacatccagttcgcggaagagcgagagccggcgcgccgagcgagcctgtccttcgggcgcttccgcggcactccttgcggtccccaactccccctacccgccccccgccccgcgccgcgaccccttcactgcagaaagagccagcgaatccccgctgctcccgccggccgcgctggctctctcggcgcctcccgggtcgcccgagcggccgcggagggcaagcgcagagccgccgccgccgcggggtccgagggtgcccggcgggtctcagcgctgccgggcccgggcagccgcagctgccgctgctcccgcggtggctgctgctggcggtggcggctccaggagctgctgctcgggctgctcgggctctggctgctgggttcgcggtggctgctcggtcccggactctgctttcttgtgctcctcggcaacccgctggaccattctgtccccgtgcagcgcgcctctctcgctcccgggacctggggactccgctctgtgtgtgtgcagcgggcagcggccgcagcagctccttgattcaatagatgagatggaagaagaaaaaaaagaactctctccatttggagaaagaagaggaggaggggaggggagggggtggagggggagagagcgagcgaaagagaaaaaggctggagctcccgcccccggggctgtcagatggcttgggtttctgcgacgcgattggctcgcggagggcagaaattactcagcaaacatgactattattagctgcttagcaacagctcaccaaagtagagagaccacccaggtaggcaacccagtgtgtgcatcctcggcttcggggcagcctctgagagcgccaaccttctcgcatgcaatacttccattaaggaatgctccccctcctttctctcttattccttttcttttcaacagtgtcttctttttgtgggatgcctttgcgcgcacacacgcgcgcgcacgcacacacacgaacatttgcctcgcggtagacacggggggaaatgtaatatttttttaagcgcttaaacaatttctgaaattcctcaaagaaaagcctttcagaggcaccttggcctcaagctgcagcaaatactgggaggtccggctcgcattcccaggcctgcaccaataatgacagcgtgctggatagtgcgccagtgtgtgccagatttttttttcctcttctcttttcttttataactaaagggaagacttaggctcttgcagggaacaacgcctcgcattaagataaacagaatggaaagttaaagaggaaagcaaggacgttgggaaaagccatctttcttaaaatccgtctgccccccagccgctttctccccccaacttaaaaaaaaaaaaaacacagtcttggtttgaaggagtcagtgttctataaacgtggaatccagacaccgaagcagtcttgtagaggcagaggcgtttttatttgaatctcgaatgtgacataagtaaaagagaaacaacagaatctttttttacaacttagagaaacggaattgtttccttgagagagtaaagttttcctgattattttgggttcatttgtacacccctttttattaaccagatgtttatatagtcagtatttttttttacaaaactcggtatgcatgttatatttaataatagtatgacgtaggagattataaatgccccgatgctggattcattgaaaacaaactgtgcgcggatcgcgaggattcgtcccgacaccgcgtccagtgtcaccaaggcatcccggggattcgcttcccgcggagggggaaaacacgcgaccctttgaggtggattctggagccagacacgtctacacaactaggctttttatttaaaaaaatttttgttttcggaaagtggaatgtgtttttcttacgtttccaagttattacgttcctccctgcggtaggaacccgacccgcaaacccttgatttgcttcactttatttttttttttaaacggggttgaactgcagagggactggcagtagcgagaagtctagtgaagtcgtgaaatggggcggtgtggctttaagatgcgcacggtgtatgttcattgaaaaaaaaagaagaaagaaaggaaaggaaagaaagaaacccagatggagggaaagggggaggagcagggagaaggcggagctccggtggccacgtgaccccgcgccaggaggcccggtgcgcgcgcgcgcccggctcccggactccccgcgcccgcgcggccggggcagagtaggtagggaggcggatgcgccgggccggctccgggcctccagcgcggtctcccgagagcccaggcgaggcgcgcgcccagccggcgcggacggacgtgccggacgcgccgtagtacattcctgaaggcggaccggcccccttacgctgcccaatgcccgcgccgcctccccgcgaccggccaatggtcgcgctcacgagtccctgcccattcagcggccccgcgctggctgcccgggcgcgctgggggctgcggcggggcgcgccggccaccggggcggtccacgcggctcccgcagggggcccgtccgccggctctccccgcccccttccttcctccccggcggtttcccctccccgcttccttccttcggcctgcgccttctccttcctccctcgccccgctccctccctcaatctcccctcccccaccagcctggccaccttccctccagcctctcctcctccccggcttcagggggaggcccttcccccgaccccctaacccgcaaaccgtatgcggtgccggggtcagggcgggatgtcccgaggaagagagggagacggggtggaggtgtttgggggcgttcgcgggatccggagggggacctgagcaccgggccagcgcggaaattcaaaactcagaccgcttaaggagcacgtgattttgtgagtgcctcagggaagggctgcggaaactcggaaagcaggcgggcagcatgcgaggaaaatgacactgagttgataaagagctcagacggctccacacattgccagtttcatctttgagtacgatcctgatgtttattaggtttgataaatagcacaaaacaggaaaagaggtttactattctagcttttcttactgaatggttatgccgacacttcaagtcgaaccattgtgtgtttgcttctggaaattgctttttaaaaactgggggaggggggtagtacccctagttttgcatgttagcctttttatatttcaagcttgctggagggcaaggaaccatatagccaaagacacgttgctatgtttgtcttttcaaacttctccaccacgttttggcccaaaactattagtgtttcgtctcaatcttttactagagggatttcagtatagcttgtttggaagaaggaattctggaaggaaatggtaagctgtgtgcccgtaatggatccgcctcactctccgcacgcggctgcatgtcctctggttccggcggctgccacatgcacgtcatttcagtggcaaagcctcttccactcaggcccatatcccttagtttgacttaattcctaaacgttttgaacattgatccccggagctttcagtgccctgagccccctcgcccgctgtttgatgggttaacttttcagcatctcagacaatggtcccggcctgtaaattctacccgtgggttccaggacgcactccggagcctcggctctaacgagcgctatcttaatctccccaccccccacccgccgcttcccctgtggtctgcttttttcatacttagagatgaattactttgaggatctaattggccttgtttctgtaacgttttaagaaagggaagaggagccagtgtaaaagcctgctcgacttgggtggtcagggctgaggctgcccccaatttgcctcattgctgatgcatgcgagtgcgacattcccagcgataatgttgttcctaatcaatctgcccttatttacatttgtaagcattgtcggctttaatatgcatgccctgtgcaggggactgctgtgccacaccgggtttgttaacttcaactaaccacaaggattccacagatctgagatgcagactggggcagccagacctgctaaggtgtcctccgggaagacagtccctttaaatggcccttctgcctctggcaccccttgtgacagttaccaaataaaaataagtgagaacttggggccttatcagccagcaggagttgccagcctttatgaagcaacagctgagtgttccatttcccctttccaagtaaagttcatctcaatgcataaattgtcattttggtctcccagtcatgatccaagacttctcattggagtgtgtagttttcaaagcagatgccttaagctctccggattccctcacatctcctcccttctctgttccaatactacaaatatccatggccacaccacacacatttcaaaaatgacatcagattatccaaatgatgacaatgaaataaaacatctgccctttgtgttgggatgttccaatggtaagcaattgtggaagccagacttggtggagttatgaaaaaccacagtgagatttaacttttcactggtttctcagatcaaaccaaatgagtctttaaaatccaatgtaatttggcaagttttgcagagtataaatgaataaaggggttaatgtattccagtaatttgaccctggggccatttataattttgtctactgagtttaatactcttccagaaatacaaggaattgcaaacatgattttaagtcctacagtatttttgttgagagggtcggatggagagaggaattggggatttgatgcaatattcttttactgcatggggagcccaggatacaggatgtgagtgatggtcaaggcagggcttcagcagttccaagcaggtaccttgaatatgagttgagtcgactcaactcaagccaatgtgccaccatccaccacattttcttggctccctaagaatgccttactattttctcattggcagcttttgtatattcttaaaaggtgatggtagaaaatgagtctaaaaggtttcagggaagtcggggacggggtggggggagattcagcagctacaaaatttaaaactactgggcttgactcccctcccctactcccttccaccttctgtttcctccccttatttaccccctccccaggctggaggaaagggaacagctctagccaacttgtcaaaataatgctgctaattacccctgatctcctttaatgggaagctgctcctaactccacaaaggagtaaatgaggggtctacagcacaaacccgggagcactggcattttttgagcttacagtgagctgggggtggggaaagcggcagaggggagtgtcctgagaaggtcccagaaatctccacattgattactccaggtctaaatactagcttgaaaggggaattagactttatgtattgccaaaagctattggtattctcttgctaagcatgtcaccaactgctgaatgttcagagcctactatgaacttgaaagaaaacagagcattgacccctgcattgatccctctctctccaaatatattcttacccacattgctttcctctcatggatagagatgtattcctacaacacccagactttgaacatgttttgcatccttccctctcctcgcctctccctgtctaatatatctctatcaagctttgcgtttgctaggaggcacaccattcatttcagtgatctctgctattgggtcctgcatgaaaaagaagctgagcaacatgatccctttgacccactgctggagcaacaaatttatcagaaatataggcatgagaaatgaaagggaagtaaaacaattccagcttattgtgtgtctttctttcatactgctaatccggtttacacatcacgcctacacgtctcaatagggcattatacactgtggcagaggctggagaaaataaaaggtgtgtgtgtgtgtgtgtgtgtgtgtgagagagagagaggaatgaggataaaaacgggagacatattttaatccacattgattaacctcatcagtttatctatctgtagaaagttgaagataattttgtaaaacagcctttttcttttcagaaaataattccaaatggttctaagttttgttcaaatagcttcaaagattatgactactttataaccagaaattagatacaccactcacagtgagtttgaaatgaagctaataccccaaattgagaatggcggggcctattgatgtctaccttgattcaacattttaattgaaacagatcatggactcaaaggcattttatagccttgtggaaggaagctgggtgacaactggaacacacataaactcacaatcgaaagccccttgttttacaacttgggcactccatgcacctgaggcaacaatttatccggagtaccacccagaaattttaagttgcaataacaaaggatgacaccataaagcattgtctttctttgtggaggcgattaattgcatgctgaactactgtcgccaataaacacagaaataaataaaaacctaaaagaaatgcacacacacagaatgctgaaaaaggactattgtggtagttcaagacctcagtgatccaattatcaaatatttagagccacccattgtggctctttattatttatgtctagttcttttgtatttctcctccccagggaggaagaaaggataaaaagggaggaagacggtcttctctcccaggtgcaggaaaacaggtctgtgggtgtcttccacagccgcccacccatatggttcttcttaggtgatggaaacagatcagtttccctgagagtgtgctcatccacacgctagcatcattttaaacatgaacgtactaaatacgtggagacacagcgcatgtcacccagaggcacagtttctgggggtcttggggttcagcgctgggcccgggcctgtaaagtgagaatcggtccggcccgcccccgggctcccctgaggccgcactctgcactctaagcactgggctggtcgcccatctctgtaagggtggcagccacccaagcgcctgaatcggtgggcataagagtcacacacaccacctctcttacccaccgccccttccagaactccaaaagcctctctggcccttttcccgcagcatgggaggggaggtgggtaaggtgcgtctcttctagcccgggtgtcccgcacccctaggcgtgcgtgcgggctcgagagcgggtctgcggggcgcgagcgtgcccttccctgcggctgcggctgctcccgcgagctggcggcagcggcttccgcgcgcgcgctctgagccccctcccctcggcgctgtcactctccgcaccagcccttccatcaccagctctgcctccgctggcgagtcagtagccaccaccaggctgatgagcggaagccaaggtggcgaccctttcaggcgtgaaaatgggagctccggcgaccccctccgtgagaattccccccggagccgttcctcagccggggcccgccgcggccagccccctccccgccacgcggggctggcctcgggggcgggggcccgggcgtgcgagcgagcgtggaggcgcgggacccgcgctcccgcgcccaggcggcgcagcccacccggctccacggccccggcgcgcggcccgcccctcctgcccggcgctcggggctcgctcctccgtccgccgcgcggggcgtcccgcgtccccgtgtccccgcgccgcccgaggagcacggcgcgcgaggcgaggtggcgtcggcggccgccgcgctggctgcactcaccatagccggccgtcaacccctgctcggagcgcgggtgccgatggcgcggacgctgggcttggatttcacatcaattccttttttttccctggcccccctttcctcgtcctccgctcctccgtcttctcccagtcttccctcgtctcccccttgccttgtcgctgcgggtctctttgtctcccctgtcgtctttttcttctcctccgttttcttcttcttcttctcctcctcctccgtctttacaaaaggaacggaaagtgtaaaaaccccggcgcgctgggccgccggaggctttcggcggagtgcagcgcggactcacaattacaagcctgtttctattaagcagttccatggccctcggcgtgggtggtctgccgcgccataggcaggacctgtcagggtcacgtgacggatccgaaaactttacccctttacaataaactcaaggaaagcaaagtaaactcgaggaacgtgctatcagcacagccctcctgggtaaacaggcgctcccctccccgccttcctgggaggcgccctgcccggcgagctcccgcgagcctagccaccctctccccgccccccgcggccgtgtttgcggggggccgccgggctgggggtctccgcgcgctcccgcggcttctccaccttgtgctcggctcccccgcccccgcacacattatttgctaacatttggccatcttgtcccaacgccggtcgggggaggtgtggggaagcaaggaagctccttttagcatcctcagcggtccgggaagtggggggttcccagaggactgcagaagaacaccacctttcatgcttgcattctcaaagcctttccttctcgcattcccacggaagcgcggaaaagctgggagccttctagatgacaggcctacgggccgccagaggggcggggagcaggaaaaccggacagatcacagcgccttcccggggaaatttcagcacgagatgtgtgcggattcgtgtcggtccctcggaagccgtttcttctgaaagagaccaaggtggcgtcccttggaaaccaagatttgtacctggtccgaagaatcacggattgacatttgctccctttctcttctgattcctgtggtttctggggtatgccacccaaatgctcccacctactgtgccgtcctgtgccaggcggccttgggtgactggcctaggagctggtgggtcgcgcggataaccctgctctcgctcaagactgaagcgttctattcgggagcgcccccgctacaatgtctgacattttatctgctcaaccccgccgctggtagacggtgtttcacacactgcgactttaaatgggccacattatgaataaagatgaattacagatacaagggcagggtagagggagtgagaacatttactgcagctctgaagagctgactagctggtcttgaaataaagccagactcttctcacttcattctgggctgacagtgtgattaggtgtgtgtgtgtgttgggggcggggggggcggggcgggggtagaagaggtgccccatgtgttattaaataataataatcatcctaggagttttgggatctccctcccacaaagatgacgtagccattcttgagcagagtcatttgagtttccagaatgtatgtgtttgagacacgttaagtaattaagcattagaaggggggcagccctgtgaatttggctggtccagaaggtcattttcataccagtgacttcagtcaaaaatggactcaaatgcatattggctgaccatggattctaaaagtcacaatagttgtaacaacaacaacaaaaaacccaacatttcccttcgaaacacttccccctgtcttttggtgtcatatcaaagggccctgtttatctataaatgtgagtggggttatgaacaggaaggtatacataatctccaaatagaggggtctagaatatgagggagaaagggggataagaaaaaagagaaacagccgacaaagggcatttaaatggcccacaatatacagttgctaggaaaattacagcagaacttgaggagtttgctttttctagttaaaatgaagaccctcatggaagcacacttggctacatgctcctgctgagttgtggccaaggctgatactcaagagtggacactagttttgtgtggcctaggacttaggcagctttcagagtgaacggggagtggggagcttctttagcaactcaaaactgcaaacacaaaattaagtacagggccttgaagtggcctgggcagggaggagccctaaagctacctgggcttctaggaaatcgcctttcttgagtgtgcagacaggaggacgacagaactacccagtctttgtggtcctggtggtctacgctgtcccttagttaggactgaatgtgttcatatgagtcttatcttagtccaaggctttacaattgggagcaaagacaagtttgttttgtacaagagtgtaagtacttagagttgggcaggagtggcataatgaggcagggagtagaaaatctggtgttaaaacgtacaagtataggaaggagggaagcccctggaaatgttctctcttgtagaatgtaaaaagttcctcttcaaagtttccccttcccttcttgttaaagaataaatcataagtgttaaaaataatagtttcttttaaaaactaacttccttcaagcctccttgctttgtgctaataactctttgttaagccctatcgtatgtagctgttaaacatgctcacaggcacatagtacattctatgtccttgtaccttaaccaagatatttatgctggacatgctcacaggcaagttccagctggcagcctatggcccttccctgtatggcacaagcaacttcctgttttcctttgtcttttcattacttttacctatttagaaaagttttaaactgttagccaatctggttttagtttagattgtgaggtctggctccagccaatggagacaggacacagtctcaggaacaaactatgtaagggataaaaattgcttccctcctttgttcaggtgtgctgtcacattgtttcatctctgatgagcaccctttctgcagaaagtaataatggccttgctgagagaattaaatttatgttcgagtgctgtttcttcgagtgctgtttctttgcagcaccagggaacaagcattctgtttctaaataaacattttccatgtaacgtctcccaaaagcaacctgtctttcttttccttcctttgaaatcaatcttcgcagattatgtcagtgctgtgcctctcttctctccactctcagatgctagaagcattaagtcaatgatataggttctggttgggggtcagggactcaacacccttatgtgttaccttctagtgcttctctgagactcccaccagggtgggccctctctcatcaaacagctgcctccacacttctaaagttgcttatgtctccccacttcccaaaaaccagctccagtgctgcccaatctaagtcaattggcatggaggtgttaatggcacacaaggctaccagacaacaccgctcagctccaagtcttcccagtctgataagccaattggcatccaggtgttaatggctgatgaggctactagacaatacttttgctggttaacttggacttttggagccatacacagaagaataattccaaagctgaagatttcagggcagggccagatggagatttagggggcattggaagacaggacaataggacttttgaaacaggcctgaaaccgactgaaaacagaccacaatgagtatgcataggcgaggttgtctttctgaatattgttgctactggagatacagtgttactctttgtttttgtttttgttttttgagatggagtctcactctgtcaccaggctggagtgcagtggcacaatcttggctcactgcaaccttcacctcccgggttcaagcaattctcatcctctcgagtaactgggattacaggcacacaccgccacaccagctaatttttgtatttttagtagagatgaggtttcaccatgttggccaggatggtcttgatctcctgaccttgtgatccgcccaccttggccttccaaagtgctggaatcacaggtctgagccactgtgcctggcccagtgttactcttgtaccatcaacatacacacttatacacacacttgcacatgcatacatgtgttcacacattcttcattttaagctcccctcttctctggctcccaataaaaatgggtgcctaagagtttccattcatctcctccctcacggtaacctccagcaattggaaggctttcaaatgagtaactgagggttcagaagaaacagttgcccacatttaaggagctctccacctcaagatgaatgctgctcttgcacatggtcagtggccataccacactggccacaccttaggcgtggtcagtctttgattctggatcagacagatcctcacaagctttcataaaagtactcttgctcaatgtggggatttcaattctaaaatgactgccccccctcactccctatcctggcctcttccttgtgggaggatattcacaagccaaatcaactctcagaattagggctttggggactgg

SEQ ID NO: 606 - DNA, 667 bp, Homo sapiens
cttctgtctagcagaatatgaagaaatcccgtttccaacgaaggcctcaaggaggtctgaatatccacttgcagactttacaaacagagtgtttcctaactgctctatgaaaagaaaggttaaactctgtgagttgaacaaacacatcacaacgcagtttgtgggaatgattctgtctagttttgaaacgaagatatttccttttctgccattgaccttaaagcgcttgaaatctacacttgcaaattgcacaaatagagtgtttcaaatctgctctgtctaagggaacgttcaactctgtgagttgaatgcacacaacacaaggaagttactgggaattcttctgtctagccttacatgagaaaaaaccgtttccaaagaaggcctctaagtggtcaaaatatctacgtgcagactttacaaacagagtgtttccaaactgctgaatgaaaagaaaagttaaactctgagagttgaacgcacacatcacagagcagttactgagaatgattctgtctagtttttatacgaagatatttccttttctgcctttggccccaaagcgcttgaaatctccacttgcaaataccacaaaaacagtgtttcaaatctgctctctctaaatgaaagttcaactctgtcagttgaatacacacaacacaaggaa

SEQ ID NO: 607 - DNA, 1733 bp, Homo sapiens
gtctcttcactctgctgattgtgtattttgctgttcagaagcttttcagtttgatacagcctcactcgctcattcagggcccccgagtagaatgggagagctccagatgcaactgactaactgaagatgtcacaaaggctgaatcttctatgctacactttggatcactagaaggaccagagtgtagtcaacgatgtgtaaacaactgagaaaaacttttctctggaaacaactgtgattttgaaattcagtggtttcttctttctagctgagaaacattgagcaagtcactgcaataacatggaatccagctgctttatctggtgaattaggataattcatagtgtacaactaggattacaattaatttatcagttaatattgctgcaaagaaaatcattctataagttaatggcttaaaacaacgattatttaatacactttttctctgtgggtaaaccgtgtggtttctctagtctgggttagttagtttgggcttggatgacttagaatgttctcagtcacacatctctggcctctgctggggtgtctgggaaagctgaactccttgttttcatgggctgtcactccgggagttagcttaaggttatacttatgatagaaaagttcccagaagcaaaagcgagtcagccttaatgtgcaagcacttcttagcaacctgcttccattagggttgctaaaatcccgtaggctgaagtaagtcataggaccaagcagaaatgaggtgggaaaataaactcattttcttcacaggagcagcctcaaaaagtttgtggtcacaaactcttcactttttttttttttttttttgcagtttccaacagggtagatttgagtattagtgaaaatgaatgcaaagtgtttgtcatgtagtaagaactaaatacattttataattgttaatgtgttttaccagccatactttttatcatcctatgatttaacaaacatgcattaagaaaatgtgtgggtaaggctgcttcaattataatcacttgagtcctttaaggttctgcttatgttatacaggatatagaaagtcatcccaacatactgactgtctcaaatgtattttgttttggatttcccaactatatcacagcctgttacgaacacttagttacataagtacattccatcttatgtcttcatttacttatttcatgacttaagttttataccaactcctccctagttagattttaatcccgttgagtaaaaagagggattatatttatctgacataattaggactacctagtacagcattggatctgaattttagattctaaacaagaatattaatatcaacttcccaactctattatatataccactgcattcaatatataccaatctagtacagttaacatcgtaggtagcattgtgacatgagccctcaaataggtagacaatcctgggattgagtactgggtctatgaatagctttgtgaccatggacaatagtaagcttctctgagcttgttttctgttatagcaagaagaaaaatatattttataatgataatgttaaaacaaaaatgtcttgctaatatggattggatttgtgtccctgcccaaatctcatgttgaattgtgatccccagttttagagaggtacctggtgggaagtgattgaaggggaacatcacactctggggtctgttgtggagtggggggaggtaaatgatgagttaatgggtgcagcacac

SEQ ID NO: 608 - DNA, 6939 bp, Homo sapiens
aggtactaggcgtgccatgtgcaggctcttgcagcccagctgttgccctggcagctccatgaccacacctctgtgcccagacatggatcagaactgggagaaaaagagaaggtggtaccttctatccccttcaccctgggtctttcaggatctgccccaaggagcagaaaacgggtgcgcccagagcagcttactcaggagacgcttgctgatacagagatgagacagtgattcctgtcctcaaggaggttacattcgcatggggagagacacatagcaaaagagaccaccaaggcaagtccgccgagagatgatgagagcccagagggcatatcactaagagaaggccaggaatgatctcacggagcaaatggcaattggcttgagttttgaggaagtagaagtttggtcaacaggctcacccttgctgatgctgagtaatctgcaggctgcaatctgcccgtgaaagaactcttgcaacacattgtgtgaggatcccaggctgccctgtccttccctgggaatcaggtcaagagccctgctggcaggtgtcctagagcatgaatcaggcccctggcaaggagaaggcgggagatcttggctgagatcaggtaggaaggtttattggatgatgtgtctggtcaatagccaatctattaaccccccctgagagaattaggaaccttcatatgatgggtcatctctttgtgggagaagtttagataactggaaaccacattttggtcaagaatgactcagttaatttttccatgcctttagtgaggatttaattttgcacgggtaagtgacttcagagtggttggtgaaagctggctggctgtcattttgtctggcagtgcagagtggcaatttatccctttaggtggcccaagatttgggtggctggactttccaaggcaatttaatttaatttatttgtttatgctgagccttgggttaatgctttcaaatggtttatttcagagatctgataacctgcggactgactttctccttctagacttgtgttgatttgattcaacagaccctcatgactcatgaagcacctatatgtaccagtcattgtgataaatctggggattagacaggggcaaaactcagtccttgttgagttagctcatggtgcaatactggactcagacataaacaaacacacagaaatgataggtttgtgtggcatgctgaaggcccaggtaagaaggaattcattctgttggataaggcggggactcaaggaggcttcctggaggaagcgaaatcctagatgagtctgaaagggtaaataggaatgaatgctctccaactctgatggagttgatgatctcagggttggcctcttttcatactggttttgagtataaatgattaatttgtttgtaataattaataaaaagaagaagaatgcattcacaagcatcacaagtgaatccatccctgacttcttagtaatttccccttttacaccctgctaatatgatccctgttttttgccctttatgaagtggtccacagtgtgaaaaatttgaaaggccccaaagaatgaatagttcttcagtaaacgaattggaacagcatattgggcatggagtcaagatgttgacctatgtaattcttttgacttttttattttaaaattactatgattccttcagggcaagcactgctttaataattcatctttctgtcttcaaaagtcagcccagtgactgtcccttattccacagatgtggaaccaattcaggattgtccttgtgattctttttcctaagtggaatactgagcctccagcttgtgtgtcatatgtgtggacttttcagcatattcttctctggcccagaagtctggattcttcttgtctgttgcaataatataaagttattcagagctgtacatgaagagaagtcccacagggaccctgggatcagaagaactctgggaaatgcctggcccagccagtgctgttctaaagatcctcatcctcatggagataaccatttttaaggaagaaaagaggatctggaccctacccatctcagtctccatcagatcttatggatgctccaggaattggccatgattctcctcttttctaccatcttgtatgttgggctttgtagaggatagatgttttctagaagaatggcagataaggcaaggtctgcagcttgccattgatagtgtctttatcaacagatctgtgaggaattgtgcagctgagaggggagaagagaaatcagagagtggatggactgccacagttcaacatatactggtgctttcaatatagaatccacaaggcaacctgcatgctgggctctgtgctaggcactaggggtatatctatgagatgccaccccagctcccacagtcttacaatctaatggggaagagagatatgtcaatagacaaacgcagcagatggcaagtgctgggatatgaaacagtaagcagaagccacagtgttctctgggacttctgagctgagtcccaaagtaattagattaatccgtcatgggaggtggagtgggtagggggagctcctggaagcatgatcaaaagtggagagctaaggtgagggagaagaaagaaatgagattcagcaaagaggaggagagcaatgaagggccatgtatgaccaggcgaaggcaaattgttcggaccaaacatgacagtagggtgggtttttgaggggtatccactgcacttacagaggcaagattctctatggtgacctttcagtgagggtgggcaaatacactactttttgagtcagccatttttcactactgagcacctctggccttagcaagttctgagcatgaatactttcttctgtttctaagccattcaacaaatatcaaagtgctttcccatgtattggtcatcttaggcaaactgggtggacatgtagagcaagacgtaatgaggtaagcactcactagagctaggtcatcttagaaaagtcacttagcttcactgagcctcagtcttcctatctgtgaaatggggataatgacccttatgtcacctggtgggcaaggtctaaataaaatcattgtagttagatccatagtaggttctttctgacctaccactgtgcacctcacgccgttgctattccagtgggatatatccagtggggttacgggtatgacatttcggaaccccaccatcacttgtatcagcaggtctgtcctaggttccccaactaagcttcctggatgaggcacctagtggcgtcccctagtttgagtgtggggggtttggtaaactagtccttatgtatgcttgtcagatggagggtactgtctttaagatgggctcatagctgaatctggaaggtaagtgctccaggccagtattgttttctgcaggattcaaagttcccttgctatttctgctgactttgcttcccctctcgtgttctatatcccaaacctattatcttcaccagcgttaatttgcctccacaactctgtttttgcattttgaaatggaatttcccttaacctatattcctctggttcccaaactccacctgcttcagtttttttttcaatatcatctacatttccttcactagattatagccttagtcatttgtacccttagaatgaatatttttttctgtcatatctttgtttgaaccttttcacatttgacttcagacattacccatctccttcatctgaccactttcttcacttttctcatctttccattttggttgtatgtctactgagcaaggggctctgtgcagagcattcaaagatgactgagatgtagtcttgtgggtagagagagacaattagaatgcaccgtggagagtgttaggttgagggaagcggagattacaggagtccaaatgtcttatccgaggatatgggataggcttgagagaagatgctgagctcatgtaggtgaggtattgtcctacgtgaaggaaaagaggcaggagatggcagcttggaggctatattactttctctggggctgccataccaaagtaccacaaactgggtggcttaaaacatcaaaaatgtattttctcacagttctagaaggtagaagcccaaaatcaagatgttggccctacagctgtgctccttctgaaggctttggggtgaatgtgtttaatgcccttttcttagcttctgcccttttcttttctggccttcacagaaggccaaagagcaatccttggccttccttggcttgtggatgcatcgtttcagtctctgcctctgttttcacatggccctcttccctgtgtatctgtctctacgctgcttctcatcttataaggacacaagtcagattggaataaagcctattctaattcagtataatcacatcttaacttgattatgtatgcaaagaccatatttccaaataaggtcacattttcaggtcctcggggttagagctttcacatgtctttttgggggacatagttcaactcataatagaaacctcgcagataaatcattttggccggtgcacagagttaagtggtggattatcaagaatatggaattttagaattttagcttcttggttgatttttgggaattaacatacaggagagcaggtttagaagtaacaataacactttgagaggccgaggtgggcagatcatgaggtcaggagatcgagaccatcctggctaacatggtgaaaccccgtctccactaaaaatacaaaaattagccgggcatggtggcaggtgcctgtagtcccagctactcagaaggctgaggcagcagaatggcatgaacccgggaggcggaggttgcagtgagccgagatcgtgccactgcactccagctggggagacagagtgagactctgtctcataaaaaaaagaagtgacaataacaataacagaggctggtcttctgggaatgatgcgatactcttcagccagcctttctgttttgagcgaagccccaacctggagttcaaagagagtgagggcgcttcctgtcttcttgtctttctcctctctcctgctacttgttatgaaattcagaacaattagagattttctgtctcatccctggaatggtgtttctcctgctggccctatcaggctggtgtgttgatgttatcggggagaggctgtagttactaggatgaagaaggcaagagagaaatggaattcacgcagatcaaacatgtgtaatcagaagacattactgaggcttgatgatgctgttcagggtgtatttcccttgaaacgcttcttaaaagacagcagcttaaacaaatgggcaagatgagattcacagaggtaacatttcagagagaatgtaggtacagctaagcagagctaagcagtgacagaaggagaaagtgtgtctgaagaaaaatcttcattacagatttgaaagaaaaaaaacccatcaaatccctctgccttgtgggtctcacaggaggcaaactttctttacaaactgtgtgtttgtgttttgagtgactaagagttcagggacaagttcaaacacacctaagttcaatttaaaagtaaatgagatgacattggaggaaatttataataaaatgtcactctttacctaacaccattttctctggaattcaaaatatccattgtttaaaagtgacacagtaactaccatctagtttgctgaatgaccttctttatagcgtcatggtattagaaatggcttcagaaggaatcactcaactgcatttatctggcaggagaaaaatgcaggtagtatttattttggggtgtggtaggggatgtcccctagcaaggatcctagaagtcagtgtcaggtatgagaacaagaaacattcatttattgcatgcatactcattgagtccctactatgtattggtattatgtggcagtatgaatattctcatttgttaaataaagatacttgagtctgctttcagtgttgtgggttttgttattaagagtaatacagtcatgtgttgcttgatcatggggacttgttctgagaaatgtgttgtcaagcaattctgtctttgtgggaacctcgtagagagtagggtacttacaaaaacctagatgggatagcttaatacgcacctaggctgtagggtaaagcccattgctcccaggctacaaacctgtagagcatgttactgactgaatactgtaggcagttgtaacaaatcactaggcaacagaaactttgcagctctgttattatcttatggcaccactgttgtgtatgcagtctgttgaccaaaacatcatgtggttcatgatcgtacttatagtactaagtgccaggcattgaactgtgccaagtgtcagggctgaatgagctcattcaatttttctaataagtctatgaggtagttactgatatcgcccctgctttacagatgaggaaactgaggcacagagataaggaatttggataaatttttataacaggtaggagataagtgatgaagagacactgaatgattgaaaactcacttggtttgatttgcttatgtgaaaaatggatttaaggaaggcagcggatgcaagcacggaggcagggaaactggttgatgtgtggattgagtgagttaatgtgtgtcaaatgcctagaatggtcactacacaagtatttgctattgttcttatttttgttgtaatcagtcagaatggtctaagtcagtggtcagcaaactttttttatgcagagccagatagaaaataatttaggctttttatgctcttaggtctctcttgcaattactcaattctgcccttgtagcatgcaggcaaccatagtcaatgtgtaaataggaacgagcatggctgcattccattgcatgtagtttataaaactatagcccacagactatactttgccaattcttggtctagactatgctgtagttataattcccaaaccctattggtt

SEQ ID NO: 609 - DNA, 1587 bp, Homo sapiens
accactgggccctgatccttcctttgtcttccaggccggagggactcgccggctgttggtgccgtatctgctcctgggaggggcagttgggtagggggagattgcctcttgcctctctctgctcaacccttttgcctctcccttaaccccgttgcttccaaagccacttcgggccccgttctacccctcagtcgtccggtctcctttcagtccattaaattccagggatgcttttactttggctgggacgaagagaaggaaggaaaagactgggaagaatgttgcgaaaatagaaatagtgggggtatacagcgacattcctaccagcctcatgaaaaggacgtggcctccatcagatggaggttgacagcaggcttgactgggtctcaggcccctgctcctcagggccacttgatcacccgcagcgtccactaggggggaaggtcttggtcatgtggcgtcaggaaatgccctagagggcctgctcacaggggcctgttggactaagcatgtcagttgtttgcacttactggacctgagttgcttagattccaaatttctcccgggaaaataagtataccgtcaactgatggaataggaaatgtagcattttttattttaattgtttatgctaaaatccagagtgctctatttcccattcctcattaacttgcatgtggttatttgccaaaatattaagccagtctcccatctagttttagaaatttcatagtatagctatcacaataagaaagatggataaacaaatagatcgtgtttgtgcttactctttcatattgtttattcgtgccaattgaggtttactgatcttagtatttaattttaattcatgtaccctgaattttgggcttctttcctaaaacacaagcaaaagaggcagagtataaattctccagaattagggggatgaaaattgatttttaaaaagctacaatttttatttatttttgcctaagctgttttaattcccacttagcttgtttgccacgcagctttatagtcattgaacaggttgactccttcagtttcatggttgtaaaattttatgtttagaggaaaatttaaatgagaaataatgtatatcacattatcatttctattaagccgtttgctaacacaataattaaaataatttctgcccagtagagaagttaccgaaactttttgtttagtgggcctcatttatgataactaagcagtatcatggaatgctgttttaaataacatcagctgtaactaagctgtaattaatcttcagacctatttagaattttgttttttgctttaaaatttatttcacattttatttttattgctttttgctttttttaatagaaaacccttaacagtgacgtatatgtatatatacacacatatataattttatgaaacttctttttatcaattacctaaatgttaaacgtggcataagcagaatacttactcttggtacatattcacatactttaatcagtttcttagttgtattttctccaataccagatactcgcatttttccaaagaatgcaatttttttcaatgtggcctttcttatttttaatttgt

SEQ ID NO: 610 - DNA, 4929 bp, Homo sapiens
gacggggggcggggcgcgcggggtagcctgggccaagggcgcgcgggcgcggggagcgggggcggggcaggcgcggaccctccctccccaggacccgccagacgcccggggcccccaacggccagcacggtccgaatcgaccccaagcttgacccgagggcagcggggcctccgggaatgcctggccagggcggtgtcgccgggagtgaatgggggagggggcggccggggcaggacccgggtcagggccactctggtagtctcctgcccacccctccccaagccgagctcccggcctccctccctctcccccgtccagggctgaggactggggaagctgagtcccgggacgggtatgggggggttggggcttgggatgcagccggacctccgggaacagcagggggccctggagccaccaggagggagaaggccccgtccctgagccaggctcgcaggtaagacccgaggccgcaaaccccggctgcccccacccccagcccaggctctgatctggccccacactggcgttttgtggaggagaccctggaagccaggggagatgtcagccaagccgcgcagcacaggggcccaacttccactggcagaatgcaagcacccaagaggcaggagtttcacccaaaggcagggttcacccctgtgttcccagagattggacacatagctggtgttcagtaaacatttgcgggatgagtgaataaatgacggagcatttattaagagcatggctgtgcttggctctccatacagagatgagtaaggcaaggggcttcacagctcttggctgtgtgtgtgtccgtgtgtgtgcatgagtgtgcatgcatttgcctctgtgtgcctgtgtatctgcatatgtgcatgtctgtgttgtcagcacgcatgcatgtgcatgtgtccacgtgtttctgtgtgcatgtctgtgtgcccgtgtgtgcatgtatctgtgtgtgcatgtgcctgtgtctgtgtgcattgtctctgtgtgtgttcatgcgtgtgcatgtgtctgtctgtgcctgtgtgtatttgtgtatgtgtctatgtatgtctgtgtgtgtgttcacatgtgtgcatatctctgtgttcatctctgtttgttcatgtgtgcatgtgtctctatatctgtgtgcatctatgtgtctgtgtttgtgtgtccatgtgtgcatttgtctgtgtatctgtgtacgagtgtctgtgtgtctgtgtgtgcatgtctgtgtttgtgtgttcatatgtgcatgtttctatgtatatatgtctctgtgttcatgtgtgttcatgtctgtgcatgttcacatgtatgcatgtttctctccatgtgtctctgtgtgtgcatgtttctgtgtatgtatgtctgttcatgtgtgtggtctgtgcatgttcaaatgtgtgcatgtctgtgtgttcatatctgcatttgttcatgtgttcatgtgtctatgtgtgtgtttgtatgtatatctgtgtgtgcatgtgcctgtgtgtgtgtgtctgtgtatgcacatgtgtgtagggggatctggggggttctggctctgagcttagtactctattcttcaaatatccgtttcttggcatcgggcatgacagcctatccagcttggaggttttctgccccttggctgaggctgggcgagccgaacacccatttctcctttctttgttgagccattcttttcttcctcaggatgtttatcccaggaaatccagaggatcagaaccaggcaggacccggcactgggacggaggcagctgtctgcggggcgtttaccgtagatacgtatcacctgttctgagacagagcctgggaggctgtttttaatcatccgggaggttgtaaaatgtttcccgacgttacgaggacagctgctggaataatgatgcaggtagctggcacacacgcagtgcaaaggtttcaccagacatggtcttctatgcctatcacctggtcaatacgagcagcagccacgttaaggtgtaatacacactggcgtcatctaacgttccatgtgaggaaactgaggcacacaaagggcaactggcttgctcaaggtcgcgtgaatggcaaagcgtggatctgggattcaagcccagacaattgggctccagaattgactttattagtcatgatcactccagagaaaacatcaagcacttttcattacatgtttaatgaaaatgatgttaaagtggttttgtaggagaaaacatttcattcatgtaaatacattttactgcattctaaaatctagcaggaaaagatgtggcctaactaccgtcaagatctgggtacatttcattggaaatacaagcacattggacatgggaaaatactggggaactttacatggaagagaatgcatctgatagtctggcgcactagcatttgctggatttttaggacatatgggaggccgggtgcggtgacctcccccagcaatcccagcaattggggaggctgaggccggtggattgctcgagcccaggagtccaagactagcccgggcaatatggtaaaacctcatctctatgaaaaaaaatacaaaaaattagccgggtgtggtggtgcacagctgtagtctcagctacgtgggaggttgaggtgggagaatcacctgagcctggggaagtcaaggctgcagtgagccgagattgcaccactgcactccagcctgggtaacagagtgagaccctgtctcaacaaacaaaacacaaaaatatatatatgctgaatgctcagtgagctgtaacatgtgaggcagcccccaggggtgccgagatgaaccgctaagaaggcgtatgttcccacggggtgcagagatgaacccctgtctgagaaggcgcatgtacccatggggtgcagcgatgaacccctgtcttgagaagccgcatgtacccacgggggtgcagagatgaacctctgggaaggcgcatgtacccacagggtgcagagatgaacccctgtctgagaagacgcatgtacccacgggggtgcagagatgaacctctgggaaggcgcatgtacccacagggtgcagagatgaacccctgtctgagaagacgcatgtacccacgggggtgcagagatgaacctctgggaaggcgcatgtacccacagggtgcagagatgaacccctgtctgagaaggtgcatgtacccacggggtgcagagatgaacccgtctgagaaggcacatgtacccacggggtgcagagatgaacccctgagaaggcgcatgtacccacggggtgcagagatgaacccaactgagaaggagcatgtacccacggggtgcagagatgaacctgtctgagaaggcgcacacacccacagctgcccctcatcttagcaccacagtgccagccccaccctgtctttgataagccctggccttccagggcctccctcagagaaccagcccctgcggagtccctgaacgtagctgcggtctggggtgccgaccctcggcactgggagaaaccctcaccagtagcatcaccccccagtgagccaagatcgcaccacggcagcatcactggggagggagtcacgtggttgtcactgcagaactctggagaggcaggctcttgcgtgggtgggggccatggaggacgcagcgtgggatttaaaatgagcccagtgaagggaaatgctggttcttcaatgtccatgagctcaagccctgtgggaggtgtagcctcgattattttgcacagatctgaacagcattcacccccagttggatatggccctttcctcgaagcacagattggaactcaaggtcactgaagtgctttctggccgcatcatggagagaaaggcattttctcactcaggcatcaccccgggaacgtggcgtgccatgttttagcatctaagtgtgtcccccgaggaggcagggttatgccgtaatcacaagcaaaccccaaacctcaacggcataaacgacacagggtaatttatcatgggattgcgtgtccacctgggtccccgcggagctctgttgactggagtcgctcggagcccccggcgcgaatgctggatggctgggcggggaggagcgctcaggggcttcacgctgtcaacaccccactccgaagtgactcccgctgcttccagcagtcacctgctggacagagaccgtcacacgggccccttcacgcagtggggtgggaagggagatcctaccgcgtacctggaagacgggagaacaggggtgtttcgatcagtccttgtagcacggccgggacttaagctctgaaccaccagtgaggaggtcgttggtctgagcctgcttttccaagtcctatcttcccttcttgggttcagacagcagatccgactgtaagtggctttaaagagacagcagacatgtttgtggcagtttattcattgcccctggatgccacccttgcatgccccctatgtgacagctagcggcccacagcccattaaccctgcagatgggcacagcaggcctcagggaggtgatgtgggttcagtgtgccgaagatgaagagatgcaggggactcaaacccactggccgaggcaccacccgtttctccaggcaaagaggtgagtcccaaccagtgaagagaagggagaagtggtgccagggcgagaacgtgtgtgtgcctgtgtgtgtgcctgtgtgtgcttgtgtgtgtgtgcatgtgtgtgtgcacatgagcttctgtatgtctgcagctgcacatgtacatatatgtgcatgtgtgcatgtgtgcctgagtatgtgtgcatgtgcacctttgtgtgcctcagtatgtacacgtgtgtgcatgcatgcatgtgcattgtgcttgtgtgtgtgcatgagcctgtctctgcctgcacatgtgcgcctaagcatgtacccgtgtgtgcatgcatgtgtgtgcatgtctttg

SEQ ID NO: 611 - DNA, 1774 bp, Homo sapiens
aaggaggaaatagctaacgctctttagtgggatccatgagaggttttgggtccagtaagacattggaagtccatgtttgcaaaggatcagggtattatgaggcatgtgaggctgaggggacagctgaccagggaacacaggcacgaacacccaggcatgtttaatggacctcagaatgtggtgtaacagagttggttaagagccaaaactcttcaatcaatcccatagacaggaattcaaatctgaccctgcaacatacttcctgtgtgatcttggccaagttactggacttctttgagcctcagtgtcctcatctgtacaatgggcatgataatagtacttgcttgtggagatgctctgagatgcctgagaggcatgtaatattatcccagtgcctgccctgtggtttggggacttacatgtcagttcgtggtgtagactgagaagctgaaaatgggacccaaaggcacattgtaaagcccatggaattgtattaaggagtttggactctatcctcttgctcagtgactttcaaatcttgacagtacataacggggttaaaggtctgaacagctcgtgtgccctgaccagttcagatctcttccggccactgctttccttcttcccaaacccctcccccaactactttatggattaagcataaaaatgcctatgggcatccacgtcctgaatctgactccttgtagtgctgagcacagatttttaggaagagagaccaggcaccccttatagaaagagctttttgatcaagagccatcaggcagcgcgtggagggcctcacctagttcttcctcctgggcttgggcatgctctcctccctgcttgcctctgctgaggactgtatttccttgaattctgcctacctactcccagcggggctacaggcgattgtctgcaccagtcctcacaggagggtgctccctgccttttggcagtcagtgctatttctctgagctaggtagcctgctctaaatcttactaggtttacaaagagaatcctccatcccacctgagaactggttatcagtagtgccatcctgctcaaatatcttcaaatacacaccaccatccatgtgtgggttgattaaggagctgacgttcattagatctgcagtctcctgacctgatgtgcatcagaatcactgggagaacaaacaaacaaaaatgaatccaaaacaagcaacgaacagacagattctcaagtcttgccaagtccaaagattgatttggtggagaaattgtactttgaaagctgcccagtttacttggcagacatctcagagtttctttctggtatctctctcaggatatagaccccaataaaacatatggcctcacacagcagcggcctcaccaggtcgcagacacatgtttagaattcctcagtctactgtgaggctggcaaagaaagccccaagcaagaaaagcagacactgggcacttttgaacttattctgggtattaaaggagcattacatgagaaagagtatgtgcaaacagcggccagcaatttcatctgacttgagagatccttgtcacaggagggagtgggtacatagctatgtgtgcagcccatgcatttcggaggtattttctaggcaaactgcatgaagtcttacatgtgtacctgctgtcctcatgtgcagaataaagccttctgtaaaagacagcagaccggagttgcatctgtgtctagggcatctgtgccttccaccaggtggagaagttcacagcagtttggattttttctgcc

SEQ ID NO: 612 - DNA, 1012 bp, Homo sapiens
aatttttttatcatgtatctgtcacttacattagtaaatctgtaagagtactgttttaagtattataataactcactttattgcagagttaactgggatgagaaaatctacttttcgtttaacataatatatatttaacaaaaattacctgattgactttatactaaccggtgtttataagaaacatgaggaaacactacaccaaaaagggccacagaagcatcaatgactgagactccgagagggaggggaccaggtactgcttctccagcaggtatgcgtaaataaatagaggaaggatcatgctccagagccccacttccagaggcactgtttggctggagctgcaaaagagtgaaataaaaattattcaaaatctactttaggaaatctacttattaaacattgggaatgaggattacagcagaggagaaaggagaaaaggcaacaaaaaaagaatgattggatccgaacatttgaaaacagaccaaaatgtaatttggtcattaaaaaatcatcagtaacaccttatacaaattttaagaaaagctttattcattcgaaaacatatttacaccacccaccttattgcgtgaacaatatacacaagatcttaatcccacaattattttaaatggggctttaatcactctttaaaaagtacataagaaataatgtattcagtgggcaaaagttctaaatcttcaacctactaactcattcctctccaacctgtcacaaaacaaaacaaactaaaacaaaacaaaataccaataaccaaaaagccagttaaaactgatctttatcacagccaccacaaggtatctaaatacacagaatattaaataaagacaatttgccaaattctcactcttcctgtttaacttttttcactatctaccaccaggatgccatctttaagtgtctaagaacactaaatggggattaaacctttctatacactattttctttttaagtgacaatgtgtaataggaccattgtttcagatta

SEQ ID NO: 613 - DNA, 1743 bp, Homo sapiens
tatttttatttgtctttctttttcaaacaccaacttgaaccagaaggaagagtttaagaaagtgaatggagaggccaggcgcagtggctcatgcctgtaatcccagcactttgggaggctgaggtgggcggatcgcttgaggtcacgagttcgagaccagcctggccaacatggtgaaatctgtctttactaaaaatacaaaaattagctgggcatgatggcgtgtgcctgtaatcccagctacttgggaggctgaggctggagaattggttgaacccaggaggttcaattgtgccactgcactccagcctgggcgatagagcaagactcagtctcaaaaaaaaaaaaaaaaaaaaaaaaaaaaaaaagagggtgaatggagagagagatatcattctggaatggtaaacaggggccagatcacgaatgactttgtaagccataaaggcctgagagaggaatgtgaaagaggaactaataataacatcaggcactgcagggcgctttgccaatcactctttttttttttttttgagtcagggtctccttctgtggcccagtctggaatgttagtggtgcaatctcgactcactgcaacctccgcctcccggattcaagtgattctcctgcctcagcctcccaagtagctgggattacacgtacgcaccaccatgcccggcaaatttttgtatttttagtagagatagggtttcaacatattggccaggctggtctcaaactcgtgacctcaagtgatctgcccgcctcagcctcccaaaatgctgggattataggcgtgaaccatcacaccgggccattccaatcactcttcatttcctgcatctcaaagcaacgctgtcaaacagttggagttgattttctaggcctttctgttttccccctcctgcttgccattgcagggcctcctctggtcactcgtaccagtgagagatcaggctcctttaggaagtactcacagcggaaaatcagcttgaaactgcctttggaaaagtatgactgagacagtgaaggagatcaaacttaactgactccctcttgctcctaacctccagactgtccttattcattcctgggtgtaggccgaactaactttgggagaaacttagtttatagtttaaacaaagacggtaacaaccctttcttaaagcagacctccttcttgcctggggactagattgcctttgtaggatgaacattaaccacaagattagaaattatggtttaggagtcatgcagctggagctacaagattccaaccctcccctaaactgctcctaagatcagtgcttctttcccaagcggctgccgaagatggcggaggtacaggtcctggtgcttgatggtcgaggccatctcctgggccacctggcggccatcgtggctaaacaggtactgctgggccggaaggtggtggttgtatgctgtgaaggcatcaacatttctggcaatttctacagaaacaagttgaagtacctggctttcctccgcaagcggatgaacagcaacccttcccgaggcccctaccccctccaggcccccagccgcatcttctggcagaccatgcgaggtatgccgccccacaagaccaagccaggccaggccgctctggactgcctcaaggtgtttgacggcatcccaccgccctacgacaagaaaaagcggatggtggttcctgctgccctcaaggttgtgcgtctgaagcctgcaagaaagtttgcctat

SEQ ID NO: 614 - DNA, 1349 bp, Homo sapiens
tatcacactctggggactgtggtggggtaggaggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaagaaagaaaaagaaacttcacatggggccacatgtctaataaaggtgactgaatcccaaaattatattggtaacatggaaattcctgataggggaagaatattcccagaagtgtgaccagttagggccaaaataaaaggtacaatttacccaattattatacctaagtacccggccttattaaatatatgttcctcaatatcaaattgtactaaaaatcaggaaactaagctcctagtagagaactggtcaaagggaagatctttgtggagtcagcagtttcctctgtcctacaatttggcaaaataatctcataagcacaagaaggttaatatgcttgcattaaaaatgttaagttacttataatccaatttaaatgtaagttcaaataccttaacatgttcacattacttttttaattcacaaaaacgttcttatctatctttattttaagatgttttccacatacatgcttagtgaattttcttttaggagatgtaagagagtctacaaatctttattctactatttcccaaaatatacccaattactggcaaaaaatgttattattaaactgatgagaaaatataaaggtttattactggattaaataagtttttccatatgcttgaattttttatacacacagtatatactctattatatgtatacacagaatacaactctatcagtattgaacttagtttgtcattccataaaatggccatagatggccagatcaagtaatcctactcattttaccctgtattactgaaaataaaaatggggggggggcaaataaagactttaatatctttaatgatgttttttaagggttagacttttattttctgacatttttctacacctctaatgaaatacatttcacatatcgtaaaacttacccatttaaagaatccagttcagtgtcttttggtgatttattcagagttttgcaaccattaccacaatctaattttagaatagtctcatcaccccatacccatcagcagtcattccctcctcctccccacccaacgttcgtgacaaacactaatcttctttccctctctatgcatttgtctatgcttaactatttcacataaatagaatcattacaatatgtgatctcttgtgactggtttcttccgcttagaatgttttc

SEQ ID NO: 615 - DNA, 1585 bp, Homo sapiens
acattttgctctctttaggaaaagacaacattgattttagaggtttttgttatggaggccagggggatttttccagtgcagcacagagaaatctgggtttggattgggaagccagacatttcttggcttacatttcctacttgaatgggattcgtttgccccctcctcacctctccccaacccccaggcagctagaagccccacctccttgcttggaccatatggggaagctggctcggtggctgttattctactgactccaagttcacgcagctgttcatcccctgcttaatgtactggttgcctgtgtctgtaccccgtttcatcttcacttctgggaaccaggctgatggagaagtcttctagcagaagtactatgggtcatgatggcagaaagaagagcaaacttggtggaccatgtgctggcccttgatgggtctactcagatgggtcacgtatctctgctcacaaggtagctacccttgcatttcatcagggctctgcttgcaagaatcgcaaggcagatcaagcctagcggcctaagattgaataactgaggcttgatagagttacatcacttgtccaaagagataatgccagtgaatggaatagccagatcgaattccagaatccgtaaagctccactgcttctctctgaatgtaataacccatccacaagccctaagatattagacacatcagtgatcactccatctgcttttggcccattgctgttgtcaggatttatgcatttatgtctgcaataattatttattgaggaccttctctcttgcaattgcatatggccttataactgaattctgactttatgtctctcttaggatagacagataaaaatttttcatatgtgatcttctttctgtcccctacctctcagctatgagcctgaaacagcagattcagtagaacagagtttctcaggaatggcagagccacaagttgggaggagcccagctctgtccaacaacctggaacatccatcaaccaggaaaactgttgcactttatgtgattaagaaacattttttaaggaaaaaagcagtaaatttttgggttatatttgttgcaatagctgtgttactttcctaatgcacaatcacaaatgtaaaatgccacacacagagtgtgaggaaatatattgctattggactacttgtagtctatttaatttttttatatagctatagccagatctggggtgaaatggtttagaataataatttccaatagtatacatcatacctttaaaaagacttttatggatggataaatatctaattatggaactgccctgcaacgtaagtggtgagagaaactctttatatatgctttgtttttttctgaatgcataggttcagaattattaaacaaatcctcatcttttgacagccagtaatcaatttctcatttgcagggaatctaattgcattagaggggacactggggaagttatggactacctcatctttctactataaaaaatgaaactacttgtctgtattgaatttgattttatatgttcaatgaaatatatcatatccttataataaagttatataagttgc

SEQ ID NO: 616 - DNA, 2548 bp, Homo sapiens
acagcatctctctctagcctattatctcctgttagacacagcccagaaaatgaatagagacaagtcctggctgggtctgggttcagaaacataatagaaggattcatctaattagcaattgaacccttgacagtacccgaaatgaaagccctagtgggtcagcactcactgtttaccagctccaatccctgctgtgcacttgcctttctaacagctccccaaggactgggctccctagagtcctcagtcccatggtcctggaaacctggccctacctctatctatgatttttgattatcagctccagcatttatggatcccttctcctattatctaatctacgggctctaaagattaaactgtgcactttggactatttaaatagttcttaaccactgatctcctccctcagggaagggaattctttccacagttgctagttcctcacacctctgcctctatgggattctcctggtccccacatgctctgctgtgtcttctagctgtcggccactgtggaggaagtgaaccttctagatcctgctgactcatacaatgagttttgtgtggaccatcagacaaaagggctggctggtgaaggtggctgttgtctggaaattcctcccagctctcctctaattatgtcataaggactggaggccccttagcctgcttgtgtgagtatcaccagctatgtaaagttggggccttagctcatcctcagcacatggctcaggatcacttccttaagaaagtctcttctgacctccttacccctaccatgtttcttgtactgacttacgcaatggtcacaaccaacatagaagctgaaatcccaatgactcactgtcccagctgcgcttgtagataagggagaggcaaagcacttagaatggcaatcagacatggctatctgggaccaggaattaggaactgctgacacaaagaagcagggacagaagagaactcactcttgtggtgagcagaggcagctgtgcaaacaacctgctgttccggatgtgactgtggtggccgtggggtgcagagtccagggctcatggcgttggtcatgcaaattgtggttcctgggccttagcagaaacaaggaacctattcagtggcattgctttgggggctgctctggcttcgtaagctgtgtgcctgattcttaagcccctcccagcaattctgggactgaagtttggtgtgttgctcttcggtttagatctgccacagtcatttgctgttgcttgaagctaaaaactctgagtgatacgaacctctcacacaactcttaccacgttgtcactacctaccccagtatatttagattccatcagatcaagtactggattttatttatctctaaatatcctaaatctccacagtgcctggagtacatgtatatatatttgacctacattaaactggtcaataaaatgaggaagtcttgcttaaagttccttctaacttaaaatttgcctgaccacatggaagctgtcaggttgctcattaatgcagaggtaatttttttctcttaactagggttagaatttagactctaccccttctctgtatctcagagggagcagaactagtggtttcctacactggagagggaactcaagtccttcagtgacctatgtcgtatgttaaagtcactcatgtttggcccctgtagtacaaatataccagaaagagtgataggaaacagcatattccccccttgttcagatttttcttagtatgacattatcttggaaagagaaaggccacatttgcaagtttggaagaaagttccccctggagttttttctctgtcctatttcagtatgtattgactctcagaacccgggctgctatgacatccgttttctgggtcactttgtccctgagtcattatcatcctgtaactttctgaaaacatttgactatgccatttaccagttaatttcagtgaatagctgaaatcatagtaaaatgttagggccagagtaaatttaggtcagattgattttattgccccagattaagaaagtgagccaagttgttgttaacaatttcatagtttccttcatcacatcttttcggagccttactcaaccataagatgaatcatccataaaatgacccccacaaagctgtggtttacatgttcatcactcttttctgtcatttgttgctttcaggataacacgcaaggaaatatgggccaactcttcacatgaacacaagatatttccatgctagccttttgcaagtaacaacagagagagctctgtgcagttttcactggaatgcctgtggattgcttgtgtcataactgtaatctaaagagttgtccatttgttgattcctttgtatttgtattggtagaattgccactatcaaaccaagatctttagctgcctttgtatcaacttctttggagcttatgtgattttccagaaaatttccaaggcatagttttgtccctaagtcccatgaatatgtaatattttgtgtctctctattaaaatagcactttttgtgcattccattaacaaat

SEQ ID NO: 617 - DNA, 2438 bp, Homo sapiens
cggtcgcttccgaactcgctgcactggaggacgcaaggttcggtcctgcctgatttcgttgcgtgcggagaccgccgtcgcggctcagaaccggagcgtgggctagtctgaacactaccctgactctcacctgggctttggccctgcgaaatcagacggggagagtgctgcttctatcgatggcagcagggccgacgggcccaccgcaaagaacacagggatgagcgtcaaggatgggagaaggggagatccagagaacctgacgcgggccctaattgatagtgttcttttctttagtagctgtagctaggattctgtgtcttcggtgccagaggggcccgcttcccttccctgaactcttccagcgtcgggaagtccctgataccaggcgccaggggtccaaatgttttatgccaatactgtaaaacctcaagtgtttggacacctgctttattcttttcttcaccgaaatcgtgtatttcacgaattcattcaaaaacctttatcaggccttggagatgttaaaagaatttacagcctagtggaagacacagattcctaattagtccaaatttactcctaacacctgcaatcatcctacaagatcttaatgtttatgtgcctcatttatctaaaaccctgaactttggctgcctgtgaatcctcaggtccatttcagcaacccacttttgcatgctgtacctttgatatcatctgaaactgcttacattgtctccggtatcagaatctaacagtatatgctgatctccacgttctagcaaattttgtttaccagcaataataggagcaacctgctctcgagagtccatattctgatccctaaatgtattagagccacagtggggcctggaacactgccttaacacctgggctaagtcctcttatatctcgtagtgaacaccttatgtatgtaaggtgtccccagcccccgggccacaaacgggtaccagcccatggcctgttaggaaccgggctacacagcaagaagtgaatctctggcaagccagggaagcttaatctgtatttacagctgctccccatggttcacattatcgtctgagctccacctcctgtcagatcagctgtggcatgagattctcataggagctggaactactgtgaactaggcatgagagggatctaggttatgctccttatgagaatctaatgcctgatgatctgtcactgtctcccatcacccccagatgggaccatctagttgcaggaaaataagctcagggctcccaccgattctacattatggtgagttgtgtaattgtttcattatatattacaatgcaataataatagaaataaagggcacaataaatataatgcacttgaatcgtccaaaaccatccttccccatccacctagcccccacccccaggaaaaaattgtcttccatgaaacaggtccctggcacccaaaagattggggaccactgccttatatagttactgagagttttttctgggcttttttgttttgttttgttttgtttttcaggagtacttaactctcagccgggtacagtggctcatatctgtaatcccagcactttaggaggccgaggcggacagatcatttgaggtcaggagttcgagaccagcctggccatcgtggtgaaacccggtctccactaaaaatacaaaaattagctgggtctggtggtacatgcctgtaatccaagctaatcgggagattgaggcaggagaattgcttgaacccaggaggcggaggctgcagtgagctgaggtcgtgccactaccctccaacctgggagacagagtgagactccatctcaaaataaaaataaaaagagtacttaactctcaactgacggaagttcaataggccttcaactgctttcagctccagatgcccaatatacatcttccccccaattttcacaattttgcatcaaagtttgtcaattttatatgtatacatatatatgcatatatctgtgtttgtacatatatgtgggccctatcaaagccaactattctaaataataaataaaaaggatccaagatatcacttagagaaagacatcagaagagtgctaattatgtgaaaagggatagctttgccaggacacaaaaaaggagacagggttgaaacccttcatcacatgtaacacaatgttgttaaaacattaaacctcctcacagccacattctgcttcaggtctctgcaaattaacattctttcagtcggaaagagcagtctttctgactgctcttaaacctagaaattactcaattcttcagctcctctgggtggcacaaatttggatgcaaatcaccttttgtagtctcaggctttggcccacttctcagaattctgcaccaatccagctgaagcacacggcctgcccccgttttctgttagtaatttgaactcatttccta

SEQ ID NO: 618 - DNA, 5963 bp, Homo sapiens
gaaccggcagtgagtggggccctagaattcccaagagtatatggcctttgtgttcagttaccagggtgggtagggaaggaccatcaggtgggggcggggctaggcggggctaggcgtggccgacctcacactctccttgggcaggacctgctgcagctgctctcggggttggaggggaggttcctaggtcaatggagttgtgtacctaggaggattatggctgcctctgctgagtcatgcagattgtcaggaagtgtgagaaagccagcagtcaccggcctcacccagccaccctgccgccattaacagcactaggcaggcagtgcgcagagctgagaacttgccccaggttacccgcctcccagctgctaaacaaaagggaggcttttcagctggttcaaattgttacaaagttcagctagagatttgcttttacctgcggcgttttccccataccactggctgccctcccgaagaattcctgtgatgccaggcaggaatggcctggttggagaccagctagctcccagggcctttcccgctgcttcctctacccctgtatttcgctgggctctctaaatggattcagctccagccttcaacattttaaaacaagaaactaggaaaggagtgaaggaatctgcctcacagattgtaaggacttgaaaacccaccgatagaccaagaggaggaaaaccttgagaccctgagactttcagaaacttattcacagttaccaaagctggcacacggatggagctgaaggccattatccttagcaaaccaacacaggaacagagaaccaaataccgcatgttctcacttatacgtggcagctaaatgatgagaacacatgaacacatagaggaaaacaacacacactgggaccttttggaggatggaggatgtgagaagggagaggatcaggaaaaataactccgacgggtactaggcttactatctgggtaatgaaataatctgtataacaagtttacatatgtaaccaacctgcacttgtgccccagaaagaaaatgtttgtggcagggagtgggacatccggcttcagagcaggaactttcattgcaccagtgatgaaaaagagaatgaaatgtgggtgacgttgagaaaggcaagaagatttttgttcagaagtgtgcccagtgcctaaaagggaggcaagcacaagactgggcctaacctccatggtctctttgggctgaagactggtcaggccattggattctcttacaaagatgccagtaagaacaaagagatcacctggggagaggatacagtgatggagcatttgcagaatcccaagaactacatccctggaacaaaaatgatctttgctggcattcagaagaaggcagaaagggcagacttgatagcttatctcaaaaaaagctactcatgagtaataattggccactgccttatttattacaaaacagaaatgtctcatgacttttctatgtgtaccatactttaatagatctcatacaccagaattcagatcatgaatgactgacagaatattttactgggcaatcctgatttaaaactaagactggcttgtggttaaatgaatgtgttcagtttttgaattttaatagtaattccaattcagtaaatgctatcactgtttaccccttctaaagatatgattagacttcactggtaatgttcaacttttcacaaagatggtgactgccatcttaaaacttactggatattggtttatatttagatttctataactggttatgtgaatatatttaaatactcgggaaattccttcactgtctcagaaccaagcaagattcatctgtgttttgtgttcatttgcctcttaaaggcaagggttgaagataaataaggtagcaacgtctactttatatttttggccttaactatgccaatctaattagaattctctgcatttaaactggttctttttacttactgaagggcattttagtgtggtttatgtgtaatatcaaagattatttaacatttctcacattttatagatgatctataaggtcacatgcttttaatatagtagcaagttaaacttcactcttgaattctttacaatctaagtcaaactaagttataatttaagattgtctttaaacagccattcagatacataaaactgtggaactgctctgtatttgtgattgtggatagtgcttttgccaacttaaaagaattaaagtagaggagatatacataaattttaaaattatgtgtgatcataagacttaagataattaaaaagaaattcacagatcattacaaaaacatgttcatggcaaagaaaagacatattctaagtagattaataattacagatgtgtcaaatatacagttctaggatttatgatgtagtcattaagttcatcaaatactataatgaaatatgtaatttaatttaaataatatttagaaattatatccatatattcaacaagtaattattaagtgtatttatgtgccagataccattctaggtgcctgggatgcatcagtgaacagaatacatctagtgctgcatgagggagcttcttttttagtgaaggaggacattagacacagatgtataaatgagtcattgaacaagataattgcaggcagagatggattctatgaaagaaataaatcagggtgatgagagggaaagtgacagagagacagctttaggttggaggctaaagtgaggcctttgaagaaatgataattcatgtgtgacttgaatgacaagataaaatgtagagagttagaggctgaggattacaggccaaggaaatagccctgtgcatatgttgtgagacatagctccaagacatagacatgcatagtttaattcaacttgactcttccagaaatgaattgaaggtcgctaggcctggagtgtcaggaagcagaggagaagttgtgagagaagagtttgaagtgagatgcctgtgtcatttaatgaagcaaatcacatgaaaaatatcactggcattttttattatacgacttatttaaaaatagcaataaaatttacttcctactttatcctaaggttctgaagacctttcaatggtgttcttggaggagagtttacaattttggtgtgtatcatgattgtaaagataccctgatatctttataaaatagaagtaaatttagaaattaaaaaaaacaaaactttcctgttctctcggtcaatcactgacagtatgtaaaatcattgcctagttgataaattcattcaagtctttcattttagttcaaggagactttagtttcctccttttggattataaaatggcagttacctggatcccttttgtatatacaattcatgacttacacataccagttttgtacatatgttgtaaatagctactattgtaaaagaaaaaataattttcacaggaatattttctgtgtataacagaaatggcttactttgatgtctttgttgaaaatatgtccataactaatgtaagaatattctaaaactttatttaaaaattttaaaagaacatttttatggataagcaatctcaatattataaaaatgacttctctttcccatgtaaatgtaaaacttcccatcaaattctgatagaacttaatattaatggatcttgatacaacatataaaaatcatgtgaaatacaagggaccaaaaaattgcaaaaatatttttgaaaatgaataaataaattagtgttacttaagccacagtatattaagtcttacagcacctgaaagtcgtattgtgcagagacagataaatggaaagctaagcaaaataatgattccagaaatcaatcaataaacaaacacatatacacatatatttgatatatgactattgccattgtagactaacaggaaaaagagaagcaattcagaaaataattaaaaattagttatacatatgaagaaacatgaacttagattaataattccttccttatattacatacaaaaataaatgctatatttattagtctactatgtaaaccaacattagaaagtctttaaagaaaatataatagtatgtctttacaacacaagatatgaagagcattctaaataaaaactccaaaagtgaatcataagctggaatgcaatggcgtgattatagctcaatgcatcttcatctccctgggctcaagcaatcttccaagctcagcctcccaagtagctggaactacaggtatagagacggagtttggctgtgttgcccaggctggagtgtagtggtgtgagctctgcttactgtaaactctgcgcctaaccccaggttcaagcaattctcttgccttagcctctcaagtagctgggattacaggtatgtgccaccatgcccagctaatttttgtattttaagtgttataccatataatttaaaaattcatttaacataacttgttcatcatctctatttttgcctagttcaacatggctgccataaactggatattgatatctatgaggttctcctctgtcccaggacaggtccagaaatgtcatcaaggagcgaagacgccagtgtggctgagctgttaacccaagctcaagagaaagtttcctttactcttctctctcctttgcccaagtggaaggggtctcttcccataggcaccgcagctggctatgtgctggttcacacttgaagtcagcatggttttgagtgtcacccaaggcccacagtgaatactgcccagctaccattgctgcttgttgagggtccaagggcactttagttagctcatgatgaattctgcaaaaattgggtcctttccttgaaggcagtgagttccattctggcccaggatgtatttcaaaatgtcctccaggatttatttttagagcagttttaggtttacagcaaaagtgagcagaaggttcagggatttgcagtatagcccccgcctgtcccacacgtgcatgcacggcctctcccaccacctacatccagtgccacagtggtacatttattacattgacaatacatcatcatcaccaaataccatagtttacattaggcttcactcttgacgttgtacattctatgtgtttggaatgacatgtatccaccatcatagtatcatacagaatagttccactgtcctaaaaatctctgtaatccaccaagtcagccttccctttccattaacactaggcaaccattgatctgtatatggtctccatagttttgcctttttcagaatgaccctatagttgaaatcatatattatgtagctttttcaggttggcttttttcacttaataatatatatttaaggattgtttgtcttttcatggattgatagggcatttctatttaatgctgaaaaaatattctgtagtttaaaggtacgacaatttattttactattcacttactgaaggacgtcttggctgcttccaagttttgacaaccatgaataaagctgctataaacatcaatgtacaggtttttgtgtgaacataagttttgaactcatttaggtaaattccaagaggtacaattcatgggccatatgctaagagtatcttcagctttcgaagaaactgccgaactgtcttccgaagtggctacacaatttgcatttccaccaacattgtgtaatagttcttgttccacatccttgccagcatttggtgtttccagtgttttgcattttggtgatcctaacaggtacattgtagaggtacctcattgttttaatttgcatttccctaatgacacatgatgtgagattttcttatgcttatttgccaaatgtatatcttctttggtgagatatatgtttggggaaaggagaatggtttgaaaatggtaatgaggagaaagaatgacactgacaccagctccaggtcccgtggaatgaaatctatggtaagtagtgttaactagggtccttagaagaggttcagacttacattc

SEQ ID NO: 619 - DNA, 1826 bp, Homo sapiens
ccaagaggtgggaacaatctaaatgtccaacagatgaatgaatttttaaaaagtggtatatatacatacattgagatattattcagccttaaaaaagaagaaaaatcatggccgggcgcggtggctcacgcctgtaatcccagcactttgggaggccgagacgagcgaatcacgaggtcaggagatggagaccatcctcattaacatggtgaaactctgtctctactaaaaatacaaaaaaattagccgggtttagtggtgggcgcctgtagtcccagctactcaggaggctgaggcaggagaatggcatgaacccgggaggcggagcttgcagtgagccgagatcgcgccactgcactccagcctgggcgacagagcgagactccgtctgaaaaaaaaaaaaagggaaaaatcctgccacatgatatggtatgggtcaaacttgaagacattaagctaaataaaatgtcagtcacaaaaagacaaatattatatgattccactcacatgaagtatcaagtaatcaaactcacagaaaaagaaagtaaaattgtggttgccaatggttcagggtgaaaaaaaagggagttagtgtttaatgggtaagaggttcagtttcgcaagacaaaagatttctggatatttgttgcacaacagtatgagtataattaatgctacagaactgttagaaaagagtctctttcagatttagatactagaaaatgtatgagtaaaatacgatgtctgaaatttgctttcaaataatctgaaggctggttggggaagttgttggagtcatacatgaaataaaactggtattagttgacaatccttaaaactgagtgggtttattataccattctctctctacttttgtgtatgtttgaaattttccatcataaaggagtttttaaaaacccaacattatcaaaatgaaaaataatcaatacaagtgctggataagaaagtcaaggaaatatcacagaatgtataatttaaaagatttgctgaggtgtgtgtatcacctgagctcaggagttcgagactagcctggccaaaatggcataaccccatctctacataaaatacaaaaatcagctgggaacactggtgcacacctgtagtctcagctactcaggaggctgagacacgagaatcacttgaacccaggaggcagaggttgcagtgagctgagatcacgccattgcactccagcctgggtgacagagaaagactctgcttggtcacttttttggcggaggagaatgcagttaaaaaggacatgtccccggggattcgaatacacttctcaaagtgtactgctggccctctgtatccatgggttctgcatctgtagattcgatcaactcaactcctggctcaatactgatggaagtaatctgcttaacaatctcagaaggactgtgcaagtcaatgagtcgcttgtgaattctcatctggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattcgaattcggtgaattgccacctccggctccacgggtgtttttccggtatccttaaaagccatggctgttgcgcgcgggcttcctgaccgacttgttcctcggcgagagcgaacagcggtgagtcaggagcaggagcgtgcggaccaaaaatcctcagcccttacgaccgcgtcttcctcaaaaagaaa

SEQ ID NO: 620 - DNA, 4046 bp, Homo sapiens
gccgcgcaggcgccgggcgggccagacgtaggcccgggggttcccggcctggccgggtagcagcgcgggggcggccctggggcggggagacagggggcggctccactccggcgctctgcggaggacagcagcgatcgccaaggctcagtgagtccccgcactagcgcggcacctggcacttggcggggccgaaccaacgaatgagcgaatttgccgagagtcgccccgtctgaatccattgactctttccttgcctcggtcctaccctcattcctcgactcacttcctcctgcccttcctcactatctccctccccgctcatatcctccctctcctttcctcattcccttcttcactctcttctctcctctcttactccccccctctcattccctccctccttcactctctcattccttcccttcctatcttacccaccattcccttcctccctcactcattcactccctccctgtctccccctctcatcccctccctctctcattccctttccctccctccttaactctcgttctctcctccctctctcattccttccctccctgtctcatttccccccttctttccctccctccctctcctcttctcccattgcctccctccctctttgattcccttctttcctcctctcctccacttgttcccttcgtcacgcgctcattccctccctcccgcggcctgctccttccccgctccctccgcggtcggtgccgctgaccgtagcgcgccccctgcgggatatcggggagaatcgcttaacaccgccagagtgaacaggtgctagtttgtgtgcccgttcctttactgagattttgcagtaaatctaattcccagtcttaaagcctggtcccagaggtccgtgcgcgggtcttggcattcattgttctccacctcaccttcgagcaggtcccatcctccgaggcgtatccgtaatggctgcgcccagagcttggagccacagagcctcctgatgggataaggttggagtgtcccacactgtggttttgagagggactgtgaagggtggagagagtggtagggggaggatgtggctggagatggctcatggttaaaaagaaaggtggggccgggcttggtggctggcgcctgtaatcccaacactttgggaggccgagacgggcggatcacgaggtcaggagatggaaaccatcctggccaacatggtgaaaccccatctctaccaaaacacacacaaaaaaactagccggtcgtggtggcgcgcacctgtagtcccagctactcgggagcctgaggcaggagaatcgcttgaacccgggaggcagaggttgcagtgagccgagatcacgcgccactgcactccagcctggtgacagagcgagactccgtctcaaaaaaaaaaaaaaaaaaaaaaaaaaaaattggtggaaggggaatgtaaaaggaggaaaatacacggaagagaattgctgtcctggctgagtccagagagataactgagggtcccagacaaggatcaagagaacgggattggcctccagaggcagaggttccaaatgggagtgggcttcctcctagaaagactttctggaggagacccccctactgtgtaacagaggaggactttgggattaagaaaagcattccaggaagccgacagtgtcagcaaacgtggaggtgagatccttcaaagtgagtggtgtggaggtttccagaattttctgagcctgaagggaaggttggagagcagaccctgccctttggaggcttgacttagccctgagggcaccctgtagccagggtgggcagatgccaatatggtagagacgaagactgagtagggagccagccacagtgctgtggtctcaggcagggagtgaagaccagagtggagcaggctagaaacctgggaaggaagcaggttccccagtataagcccagtgatgtgtgaagaatgagcccaggagatgggtggggaagtaggcccaccctgcctacaggggagccagagcaagagcaggtctgggggaagatgaggccccccttggctccaggtaggggaagactgacctccaaggcccaatgggaccaggtgtacgggtggacccagagaggagaggaaaaggaatcctggggcagcaacaagaaggccactgtggtctgaatgtcggtacccccaaaattcatatgttggaactgaatcctcagtgcgatactattataaagtagggcctttgggaggggtttaggtcatgagggtgaagtcctcaccatgggatcagtgtataaaagaggttcgaaggagctcatcccccacttttgccaggtgaggacactgtaataagcaccatcttcaaggcagagaatcggctgggcgcagtggctcacgcctgtaatcccagcactttgggaagccgaggtgggaggatcatgaggtcaggagatcaagaccatcctggctaacatggtgaaaccccatctctactaaaaatacaaaaaattagccaggcatggtggtgggcgcctgtagtcccagctacttgggaggctgaggcaggagaatggcgtgaacccgggaggcagagcttgcagtgagctgagatcgcgccactgcactccagcctgggtgacagagcaagactccgtctcaaaaaaaaaaagcagagaacggacccctcactagacactggggcttttttctgaaggctactgtgtcatataaaatttatattaaataaattgatatgcttttctcttgttaatctgtcctttgttagaggggtgtcaaccaggaaccttgtgatgcgtgaggaaaaaatattaccttttccccctactctttctggcacccaacaaacaagtggggtggcaaagacaccccacttgggacaactggcaaaagctctatgatcagaagatggcataagtggggctgggcacagtggctcagtgcccagctgggattacgcctgtaataccagcactttgggaggccaaggtgagtggatcacgaggtcaggagttgaagaccagcctggccaacatggagaaaccccgtctctactaaaaatacaaaaaattagccgggcgcggtggcaggtgcctgtaatcccagctactcgggaggctgaggcaggagaatagcttgaactcagagggcggaggttgcagtgagccaaggttgcgccactgcactccagcctgggcgacagagtgagactccgtctctaaaaaacaaaaaagaagatggcgtaatcagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccctccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcactttgggaggccgaggcgggcagatcacaaggtcaggagttcaagaccagcctggccaatatggtgaaaccccgtctctcctaatgatacaaaaaaaattagccaggtgtggtggcattcgcctgtagtcccagctacttgggaggctgaggaaggagaatcgcttgaacccgggaggcggaggttgcagtgagccaagattgcaccactgcaccagcctggcgacagagcaagaagactccatctcgaaaaatatata

SEQ ID NO: 621 - DNA, 3615 bp, Homo sapiens
tttgctatatttgggtaatatatatttacatatatattcatttgacagagattctttatttatgaaagcttctcccaaaattctaagaacactttatgtgtgcatttacaacaaaattcctctttttctatcttttttttttttttaatagagacagggtctccctgtgttgcccgggctgatcttgaactcctagccccaagtgacctcctgccttggcctcccaaagtgctgggattataagtgtgagccacttctttttcataagaggtgtgaaaaccagttttcataaaccttttcaggaatgcttttttttttaattaaaaaccaagttttcacatcaaaatgattgtaaagacttttttttttaacattttaaatttgaaatagaagtgtatacctagatctcttcaccaactaggaaatccattgctgagatagcaaaattttctttttctttttttatttttaatttttgtgtgtacatgtatatattcatgaggtacatgagatgttttgatagaggcatacaatgtataataattacatcagggaaaatggggtgtccatcccctcaagcatcctttgtgttacaaacaatccaattatactcttctggttattttaaaatctacaattaaattattattgactgtagtcaccctgttgtgctatcgaatagtaggtcttagtcattcttcctgtttttttgtacccattaaccatccccacctcccccataccaccctgctaccctacccatcttctggtaaccatccttctactctttatttccatgattcaattgtgtgtatttttaggtcccacaaatgagtgagaacatgcgatgtttgtctttctgtgcctgacttatttcacttaatgaccatccatgttgttgcaaatgacacaatctctttttttttttttttttttttttttgagatggagttttattcttgttgcccaggctagagtacaatggtgcagtcccagctcaacctccatctcctgagttccaagcagttcccctgtctcagcctcccgagtagctgggattacagacatgcgccaccatgcccaactaatttttttgcatttttagtagagacagggtttcaccatgttttccaggatggtctcgatctcttgacctcgtgatccacccgcctctgcctcccaaagtgctgggattacaggtgtgagccaccatgcctggccataatctcattctttttttatagctgaatggcactctattgtaagtaccacattttctttgtccattcatctgttcatggacacttgggttgcttcctaatcttggatgttgtgaacagagctgcaacaaccatggaaatgcagatatctcttctatttgctcatttccaggaagcaggattttctatcagcctgaaggagccgactcttggttactcatgtcaaggaaaacacacacaatttaaatagtgatcatttatgatcttgtctacatagtattgaactacataggtttttccctcacattcagtcaatgttgagcacctactgtgtgccagacactgtctaggcaccagggatacatgcaggaatgaaaccgacacaatctgttacttcacggagtttatattctggcattaacttgtttttgaaaatttaggctgtaggccctttctacagcctagttagctgaagaagctttctctggatgagctgaagtaaccttctcagcatatctccattttcacaagagggaagaaaggcactgggtgatgaagggatgtgcccgctgtcagctggccagcttgtggtgcagctagctgccagcccaggcagggtatctgtcgagctcttcttctttctcctgttccaaccatttcagggctggctggctgctcaggtctcatgaatccttacctggaaaggttgcaaagtttgttagcctctccatctttaaaaaaaatgtatacttgtttttaaaattattatacagtaaaattgacttcttttggaggatggtacagttctatgaattttaactcgtataaatttgtgcagccctcaccacaatcaggatacaaagctgttccatccacccccaaaaatctccctgtatagccacacccccccccgactaacctctggcaaccactaatctgttctctctccctatagctttgccttttctagaatgtcacataggtggaatcctgtatacctttgactgacttctttcacccagcataactcatccccatctttattttttttccttttttggaaaatttccttccacccatacacctgatttgagcattaacacctttcagatgattatatgttcaccacaagcctcccgctcttaaggaaactgataaagtatcttattgtaaagggtttttctctggagtgaagttgcaggctctgggtagttctgttgtgctgggtttttgttctgtgcctcccgtatgtgcataggaaatgtgtctttgaatgatgggggagctgtggaacgcactgccaaaaggaggtttcataccctgttcacctgattgtgtcacagaaatcagaaaaggaaaatctgtgtcagtgaatttcactattcaagtacagtcaacccctccagattcgggcatctgtagagtcaaccaaccttggatcaaaaatatctggaaaaaaaaattgcatcggtactgaacacatacagacttttttccttgtcgctgttgcatgaaataatacagtgtaacagctatttacatattatttacattcattaggtattacaagtaatctagagatgattcagtgtaagggttgtgctgtgtgtcagttatatgatttgatgtatggagtgtgctgtgcgtcagttatatgcaagtactacaccattttatatcagagacttgagcatctgtggatttgggtatctgtaggaagatctaaccattgcccactgatactgaggggtgactgttggcatggctgtcacaaatcccagaattcactgtgtatttgttgtcttagtcttcatcttaatcagtattctaggatttttttctacatttttgcttgtggtcttcactaaaatattttaacttttctgccctgtatcttatcttattttgacatttttaatattatgtataatatctcattttgaaaacttaaaaaaaaaaaaaaactatgtgatttatatatgtagttctccgggtaaaaaagaacctttctcctttttgaatttttgagatgttacctaccagtaatgttggtactattataaggcaatcgtcttataaactttttcactaaatagtcattttgttttctttgttttcaacacagtttttacgtaacagaactgttttcctcatcactattagaaatcagttgttaatgtgcatgctagtgttttgaattttaatattgattataaattcacatgtagattagtaatttgtaaaaaaaaaaatgtaaatttatgtaactcatttttcagatactttggtactaatgttattttatcgttaccaattcttacaacaaatataccaaactatggatttaaatgttttggcattaaaaactatttgataataaaatcaggaaatttta

SEQ ID NO: 622 - DNA, 1491 bp, Homo sapiens
tttttttttttgagacagaatctcgctctgtcacccgggctggaatgcagtggcgtgatctcactgcaatggctcagtgaatggaatggcacagtgaatggaatgcagtggtggagctcactgcaagctacgcctcccgggttcatgccattctcctgcctcagcctcccaagtagctgggactacaggcgcccaccaccatccctggctaatttttttgtatttttttagtagagacaaggtttcaccatgttagccaggatggtctcaatctcctgacctcgtgatccacccgcctcagcctcccaacgtgctgggattacaggcgtgagccaccgcgcccagcctaggaaaattcttctataaagggcctattgaggttaaagcagctccatcttggatgctactctgccagatggagtcttgctccatcgcccaggctggagtgcagggatgccatcactgcaacctcagcctctcaggttcaagtgattctcctgcctcagcctcccaagagtacctgggtctacaggcgcatgccaccacacctagctaatttttgtatttttagtagagtcggggtttcaccatgttggccaggctggtcttgaactcctgatctcaagtgatctgcccgcctcggcctcccaaagtgctgggattacaggtgtgagccactgtgcctggcctcttgcatcatttttatgtgcagtcaggaggtaccttggtagacgcatctatgagagcagaacctgataattagggaaaccaagttcaggctcagtgctgtaatcctccatcaggtctcatcacttgaagacaagcagcatattcaatgtcctctaaaggacaataaggtttcttgaggatagagtttctgtgatcttagcacctagaagagagccttgcacacagcaggccatcaataacatctgaataaaggattaatgatgttccagatctaggaatcagtcatttatgattctaagttacggatagttatattatagatacagatatacatatacatatacatatatatcaatatagagatataggcttatgcatgtatatatagagagatttatatatatatacatatatatatatcaatatctgcctatatcattagtaacagataaatcacagtctgcatttaggtaaattatgtacttatttgcctatttaacattctatttcttgccataaaattgcaagttccacaaggacagaaaattggcctggcttgttattgttctattgtcaatgcctagaacagtgtccggaacacagtaggtattcaatacatttttttaaattaatgagtgaacgaattgttgatgcacaataagtacatagtttctctctgagtttcatgcagacacagaattttttcttctgttctccagctgtgacttattggatgagaattgcataatcacactaattgacttcataacaaatttatgatttcccatctcagccagactc

SEQ ID NO: 623 - DNA, 1417 bp, Homo sapiens
taggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaat

SEQ ID NO: 624 - DNA, 2324 bp, Homo sapiens
ggagatgcggaccttgaggcttaggatcccctcctagccgagtggagtggagtgggaatgtccagagccctgaaccttcacggaagcccccgagacacctattattagtgacttcctctgaaatattcagtttaacatatagaaatatggtttatctaggagtgttgttgttgtttggcttaaagctgtctgaaatgggtttctgtttcttgcaactgaagagtcttagctgaagaggcttaactagggcaacgatgcttcagtgtggttatgaggattaaataacataaagtatttcaagcacttcagttagcacctccagaaatgtttctcccctcttccaactgttaacagtatcgcatgtaccgagaccatcagacttacctgtgttttgtacatgctcaaaataagagcccattttgcggtcagttttcttttctttttatttatttatgtatttatgtatttatttattttttgagtcggagacggagtttcgctcttgttgcccaggctggagtgcaatggtaagatctcggctcaccacaacctccgcgtccctggttcaagagattctcctgcctcagcctcccaagtagctgggattacaggcatgcgtcaccactcccggctaattttgtatttttagtagagacggggtttctccatgttggtcagggtggtctcgaactcccgacctcagattatccgccccccccccaaccccggcctcccaaagtgctgggattacaggcgtgagccacctcgcccagccagttttcttttttgcaagtttttcctcattccatctttcaggtggtgttatgatttatgtttttttttttgctatgttttaaagttttgtttgttcctgaaaggattgagttagtcatactcctcagttcatggcatactatcatcagaccatgacagtgaggccctcttgttttatttatttatttatttatttatacccttcaagtcccattttctcactacaataggcaattttctaatgtgcttaatgtggatatttccatttatgtgttttctaaacatagttattatttcgtgagcatgcattattaaatgtacttcaaacctactgagatatttgtctcattacttatatttgtttaacctaagcactgttttttggctccatccacgttgccagatgttaatatttaatctgttacttcacattgatgcctaatagtccgcggtatgcatctgtccactcttccattgatgagctcccatgctgcttccaactccatgctactacaaataaccctgcattgaatccccttgtgaacttgtaaataatttgttttatgttacttaggggaggaattgctgctgggctactgggtataaatctgtttaatgtgtccgagtaatgccatatcgctttccaaaagtggtggaaccaatcttgcagcagtgcaagattctgtatttccacgtctgacaacacttgcaatttttctttttcttttcttttcttttttttttttctttttgaggcagagtctcactctgctgtctaggctggggtgcagtggtgtaattatggctcactgcagcctcccaggctcaaccgatcctcctgcttcaacctcctgagtagctgggactataggcacatgccaccatgcccaactaattttttaatttttttgtagaaataggatcccactgtgttgcccaggctggtctcaaactcctggggtcaagtagttctcctgctttggcctcccaaagtgctgggattacaagcatgagccactgcacccagccaacatgtgctattttctagatttctaatcactggtttgataggaataaagtgatatctcattatttgtttaatttgcatttgattactaatgtaaatttccatatatttattagctttctcctctgcaattaattgcctgttcatattctttgcttcttttttttaaattgggttgctttttcctgttcatttgcaggcgttccttacatattttagggtgatattacactgttgtcagttttagacaaagcaaatatattctccattctgccatctgcccgttaacttcgttaatgatgccctttatggaacagaaatccttaattttttaataatgaagctccccagcttttgctttatgacttgcgcttttaaaacgttgaaatatgggtaccactttcttagttgtgcttattctctgccagatatctccaaatctgaattcactggtgaggtctctaggcattccattcactcctcttcactgaattccaaagtcactgttctgactgaatttaac

SEQ ID NO: 625 - DNA, 2249 bp, Homo sapiens
agcagagcccataacatcctttcatgttggtgctttctgattcacagattgttcaagtaaactttgttaaatttcttttgtcagaagttcttcttttaacaattgtgtgttaagacataactctgggagcgttttgcaaaatgcttttgaacagggagaaaatgttggcatgaggatgagtttggatgcctttgaaataatccaggcaatagataactttaagagatgggagtgttccaggtggagtaaatagcttctgcagaagcccacaatctaaatgcccaacagggaacatctgcttggaactccctttgcttgctcttcgccagtgcctttgactttcatcacacctgttcaccagctctatcagcttggtagaagtgaaagccctactcctggcaatgggtcatttgagcttagaggagtgggctggagaagaggaaatgataccatgttcttttaagaaaaaagaggaaaaagcccacaagatgaacactatggtgtataaccctgtcatgtctttttagcaatgaactttggagccctggaaacaagtagccctaagttacaacactcaattttaaatgggaaagagcatctcctaaaagaaaactatccagagaagctgtgaagagaaattcaaaggaagggtaaactctgagtttacagtgtggcttcttgccattttgtatattgacagaacactataagccttatgtcaatatcctgtaaaggatgagtgtcacaggaggcatgaaaaataaagctgaaagaaatttgtataatatctataaaagcacttctaaccctgagagaaagcattaaaataaaagagaggggctgtatgttatctctgtttctgcataagaatgcagaagaattcatgaactctgcgaatgcagaagttaatgaacatcatgaaaagaataaaagaggaatgaaaatgcaaacatacaagtttgggatgttatcacacattaatcggaaatgcaaaaataaattgacaatactatgtgttggcaagaacacaatgggaactctcattcactactagtgggtgtgtaaattaatacaaactgtttgaaaacagttttaacttgtcctttcaaactatactacaaggctacagtaaccaaaacagcatggtactggtaccaaaacagacatatagaccaatggggcagagcagaaacctcagacataacaccacacatctacaaccatctgatcttcaacaaacctgataaaaacaagtaatggggaaaggatctcctaatcagtaaatggtgctgggaaaactggctagttatatgcggaaaactgaaactggaccccttccttacaccttatacaaaaattaactcacaatgcattacaaacttaaatataaaatccaaaagcataaaaactctagaagaaaacctaggcaataccatttaggacaggcatgggcaaagacttcatgacaaaaacttcaaaagcaattgcaacaaaagcccaaattgacaaatggggtctaattaaactaaagaccttctgcacagcaaaagaaactatcatcagagtgaacaggcaacctacagattgggagaaaatttttgcaatctacccatctgatgaaagtgtaatatccagaatttacaaggaacttaaacatatttacaagaaaaaaacaaccccatcgaaaagtgggcacaggatatgaacagacacttctcaaaagaagacatttatgcagccaacaaacatgaaaaaagctcaacatcactgatcatcagagaaatgcaaatcaaaaccacaatgagataccatctcacaccagtcagaatggtgattattaaaaagttaggagacaatagatgctggcaaggctgtagagaaataggaatgcttttgcactgttggtgggaatgtaaattagttcaaccattgtggaagacagcatagtgattcctcaaggatctagaaccagaaataccatttgtttcagcaatcctattactgggaatatacccaaaggaatataagtcattctacacatgcacacgtatgtttattgcagcaatatttacaatagcaaagacatggaaccaacccaaatgcccatcaatgatagactggataaagaaaatgtggtacatatacaccatggagccataaaaaggaaggagatcatgtcctttgcagggacatggatgaagctgaaagccatcatcctcagtaaacaagcacaggaacagaaaaccaaa

SEQ ID NO: 626 - DNA, 1106 bp, Homo sapiens
ggaagaatgagacacctctcctggcttctgatgttcccatccctgaggaggaacacctattactctaatactcccgcctctgtttcacacctttactcactttccccaggaagactgtatattaaagggttcagcatggggatcaccgtggtgtagaacacagaggacaccttctcctggtccagggagttacttgaagggggcttgaaatacatgaaggtaatggacccaaagaagatcaccacagccatgagatgagagctgcatgttccaaaagctttggaccggccctctgaggagcggatgtgaaggatgctgtagaggatgaaggcataggagacagcaacagctagggtgggcaccaaggtgttaaaccccgcaatgataaaaagtagaagctcattgaggtgtgtgttggagcaggagagattgaggaggggaagaacatcacagaagtaatggttgataatgtgggatttgcaaaaggacagtttcatcatggcacttgtatgagtcaaggcagagagaaagcccaagaagaaggcagccagcactagcagtgagcagacccatgaggacatgatcgcattataaagcagtgggctacagatggcaacatagcgatcatatgccatggcagtcaggaggtaaccctcagccaccacaaagaccacaaagaaaaagagctggaccatgcactcagagtaaaggattgtattcttctttcctaggaagttcaccagcattttgggagtaatgacagaggaatagcagaaatcgacgaaggacaagctgctgaggaaatagtacatgggggtgtgaagtagagggctgactgcaatcaggagaatcatgcccaggttgcccactactgtgaccacatagattcccaggaacaggaggaagaggggcagctggagctctgcttgctgtgttaaaccatctaagacaaactgagctgccatagaataattttccatggtcattcttctttaggcatttctgtgaaaatagaaagtatgaattaccttaacatggaccctcactgctcttccaaacaaaaccaaattgcataagggaggttgacagcagctaacagactgagt

SEQ ID NO: 627 - DNA, 1318 bp, Homo sapiens
gtagcttccacgcgggcaggtccggaaactgagcatgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccggcgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgata

SEQ ID NO: 628 - DNA, 2549 bp, Homo sapiens
ctttgagcaagaggacaaacctgggtagggatctctatgatgttttctgcgttgcccgtggacgttcatctttctgatttgttagctgaagatgaggatctggagcaggagctcggagtgccattgttccatgggcagatgtgcagcagagattagcattaggaagacaagcagggccttcagtaggcataaggtgatgaggttcatgccgttggatcccacgggtgccctggggaagagatggttgggaagtctgagaggaagcaggagagctttcggagcacatggatgccgtccagaatggagatggttgtggctcggaagaaaaagaaatcacccagctcggagtcaggatacatttggaggtccaggccgccgagtttgctggtggggaagataggcaccagaaaggaaagaggacatccagggcaatttcttctgccccccagccaatccgtacattgtccagagggtcttgctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggtaatggccaaaggtgccattcaggtgaaatccccaggtggaaaattcttccacttccaatgatagaattctattactctgcctatagtttggtgaaacaagactttacaaatagaggacaagatccattttgccaagaacaaccatatggatttaactgctgctaacaaccgttaggaaggaacatcaataaaaagcaagcctgtgagacaactccttccccaaggggcgcttgttacagagcgcgggccccagcaggcctggtccatcctccacattctttcctctctgacttatttttactttctgtttgaattggcttggttttattttgccctaaactgtgtctgtagtcatcccccgacagagttttgagagtgaaagtccgatctgcccacgcttcacagaactcaatgcggagccttctcaggagtcacttgacgtcaaggctgacttttaaatttgccaaaaaggcattctttggggagcggtcggcaccatcactttccctctttagagagctgctactggctgctggaattcaaaacccacaaattgcatttctaaacttaattcgatacatagatgagcggaaagatcagacattgatgctattgttttcaaccaagatgttttactatatcatttatattttgtttttttcttcccccagtttttaaactttttgtttgtttgttttacaggccaagcctactgctgttagaaaacatatttagaaatcacttggttcttccttgcctgaacatcatctatttagttagcttgtgttgtttagatgtgcttcagatctcaaaaaaataaattatgttatttgaaagcttgctctctgcttgtttacactattaatttagagtccagaggaatctctaaatttgcctctagaaaccacataatcacctaataatacctttcctgactccactttctgacacaaagtgacttttgaaacgcttccatcttccctttctatttaatgtactgcactccactcttttttcctttcgttttttctacagtccgtcatggagtatttgtttaccaaatgttacttttcttggatccaatctatttttgaagagcgcaaaagcaaacaactgtttgaagctgtcaagcttcattttatttatgcatgaataacacaaataacttgaaaatgacctagtctgtttttctcagatttagatagaaaaactgcttccggccaatgtttatgccaatttgttcatgccaagtttccagtttcggtgccaaccggtttttacagccaagttgtaaaccttcggtaaacatggcttataatgaaaagtgcaacacagcctgaaccctggcaccaggggacggatgtaaatttattctaagaacaaaattctaacaggaacaggaggggagctaggctggctacaaagtgttcccaccgtaatatggaaaatgtacagatgatgatatatttgattactaagatcccattaggccaatttaggcactttatgtatttcctttgctctggacgctgagtggtttcatgctcaatttgaagcaactggctcattgtctcagggtggttctagaactttgccttcaggtggggctggggagggagcc

SEQ ID NO: 629 - DNA, 910 bp, Homo sapiens
tatgacagatgccactgtgaccttctccaaggactttctggcaggtggcgtggctgcggccatatccaagaacacagcagtgcccatcaagtgggtcaagctgctgctgcaagtgcagcatgccagcaagcagatcaccgcagataagctatgcaaggactagacagactctgtggttcatacccccaaggagcagggagtcctgtccttctgccacggtaacctggccagtgtcatcagatacttacccacctaggctgtcaactttgcccaaggtaaacagaagcagatcttctgaggtggggtggacgagaggccccagttgtggtgctacattgcaggcaatctggcccccagtgatgccactgggccacatccttgtgtatggtgtaccctcttgattttcgcagctacttgactttgtacctgtctagcagctaatgtgggtaaagctagagctgaaagggaatctagaagcctcagtaactgcctggttaagatctacaaatccgatggaattaagagactgaaccaaggctttaacgtgtcagtgtggggtattatcatctaccaagctccctactttggtatccgtgacactgcaaaaggcatttttccagatcccaagaatgctaacatcttcatcagctgatgatcgcacaatctgtcactggcattgctgggataaaaagtcattcctatccatttgatactgtttgccaccacaagatgacagggtcagggttcaaaggaactgatattctgcacacaggcatccctgactgctggaggaaaattgctcatgatgaaggagacaaagcttttctcaaaggtgcatgatccagcattctcagaggcatgggtggtgtttctatgcttttcttatatgataaaataaagaagtacacat

SEQ ID NO: 630 - DNA, 2554 bp, Homo sapiens
aagtgctatgggtcatccaggtgaagatgttcagtaatttaacaaatatgtatcaagtgtctcctatgtgctaggcactgatgagtatttgaggagagagatttgggagtgatttgggtatcatcaatgtatcataaaagttgaagtcttgggaggggacaatcccacattcagagacgtgatgtagattaagccaagagaggactaaggacaggactcatctctgggaatgccaatatttagggggcagacttgagttgccagaacagagaccaaagaggagctgccagaaaggaaagaaaacgcttctggaggagagtgtccaaaaagccaaggaaagaacaaacttcaggaaagagggagaggccaacaacatggaatttcgaggaggtcaattaagaccactgagttttgcaagaataaggtgctcattataaagcatctgaggagttcagaagagcaccaagaaatttaaaaactaaagtcctaatacctgtcttcgacattaggtgaacattccagacatatatacagacagaagaccacatggatgacttatcaagaaacgaaaaatgtttacaaaaatgagatcccactacagtattatttttatttatttatttttatttttatgtttttgagacagtcttgctgttgcccaggctggggtgcagtggcatgatctaggctcactgcaacgtccgcctcctgagttcaagcaattatcctgcctcagcctcccaaactgggattacaaacatgtgccaccacgcccagctaatttttctggggttttttttttcgtagagacggggtttcaccatgttggccaggctggttttgaactcctgacctcaagtgattctcccgtcttggcctccgaaagtgctaggattatgggcgtgagccactgcacccagcctattttatttatttttcagaaaaagtctcactctggcccaggctggagtgcagtggcacaatcatagctcacagcagcctccaactcctgggctcaagcagtccttccacctcagcctcccaagtagctgggactacaggcccatgccaccaggcctggctaattttttaaaaaatatatttttaaggctgggcacggtggctcacgcctgtaatcccagcactttgggaggcagatcacttgaggccaggaattcaagaccagcctggccaacatggtgaaaccccgtctctactaaaaatacaaaacttagccaggaatggtggcgcatgcctgtaatcccagctactcagaaaaaaaaattatttttagtagagatgaggtcttgctatgttgcacaggctggcctcaaactcctggcttctagctatcctcctaccttggtctcccaaagtgctgtgattacaggcatgagccacggtgcctggccctgtgttgttttactgtttaaaactgttttactgtttactgtttaaaaacagtaaataaggttaggcagatggctcacgcctgtaatcccagcactttgggaggccaagatgggaggattgtttgagcccaggagttcaagaccagccttgggcaacatagcaagacctgatctctacaaaaaacagctaggcctggtggtacacacctgtagtcccagctacttgggaggctgaagcaagaggatggcttgagcctggaaagcagaggctgcctagccgagatcgtaccactgcactccagcctgggtgccagagcaagaccctgcctcaaaaaaaaataaaaaagaattagctgtgcaattcagagtcagctatggcctgaacggattaagaagctggggtgccctagactggtgtttggggagagtcctgggttggaaggagatgactgtagtctaggctgaccacatgcagactcctaggtgacttatagggctcatctgggtgtgctcaggctggtgggcagaggccacggtggtgctccgcctggggctgaggcagagcgtaaccctgatccactcctggaaagccaagaagcatcctatggcacacgttctagtttagacatacctgctggggagcgtgctttgcaacatggaggagggagcacttcttcctggcaggacaccctgggtcctcagaggcactccaaggtgctccaaagtatgacagcttttactattttactgctgtttacactgcagaatatatgaaagccacactctcttttcggggatagagaccccttgttagccctccactgagaagcagtggagaaactctgataaacaatgattgactaaatgcatattctgtgccaagagcttttcatatactatactaagtcattcaatgtagtgactatatagtcagtattcttgcccctgctttatacgtgaagaaactatgcttcagagaaagcagtttgcccatggttgtcctcaagcagatggaatccaaacccaccgggcatggtggccacacctgtaatcacagcactttgggagaccaaggtgagaggatcacatgagcccaggagttcaagaccagcctaggcaacataggaagaccctgtctctac

SEQ ID NO: 631 - DNA, 2189 bp, Homo sapiens
tgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatcttttaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactggactctgagttctcacagctagtttcatctaagcttggtttattatcatttctgctttggatttttttgtgcatcacatgaatacttagaaatccatttgttttcagtgtagtacctagggtgaagtagatgctgcacaagtaagtttaagggaataaaagtcccgacactttatatacatgttgaggggcacgatttaagagactgaaacagtttacattaaactgtttttattttctgccagtagactctatctgcttaaaaaaataaaaattgttcaacccagtgttctccagcatcaggacattacagttgtaatctatgttgtaatcttttcaaataagaaaagctactccttattctctacagtgtaggcttaattttagaaccgataatttactatatctgcattattgatatttttaagtagtagttttaaaaataattatttctatgtggagggtgttttaatttgggattttttttttcttgtaacaggtgctatttgtaaatatgaaggggaaaagtcacttagttaaaagtctagcttatgtcataattaagatacaattattcatttcatgtttgattctattaaactagtggcaaaacagaattggtcccttagttttttagattacctttccccctatatcacaaaaatatctctttccatatgatctcataattgaggcaaagaagctaagggtttatttaaaatgtgtataagcttgaatttggtcaacactgcataatttgaaatcactctgcatttgtcactgcagcttactgtatgcttgaaaggccttgtgtgtttgtcttaattttagtgaaaaaattagaatttctgccattcatgtacaaaaaaattacaactacagcaaacaagataaaaatgctggtttgcattaatactgttttagtcttaagagcaatttatattatgtgaaatgctgttacacatattttgttggccatatttcattttgagaaacagttgttcaggtacaaacatgacaaacaactctagctatgactcttaatgttcaattgcaaaataaagatgtgctttagtaatctaaa

SEQ ID NO: 632 - DNA, 4317 bp, Homo sapiens
acgcccatgtgagcggccgcgagcgctgggaggacggacccagcggtcgatgacagggcctggcgcggttcgcttttcctgggtgactgtgttcgtggggctgaggccctcgaggtgcccacttccagctttccaccaattactgcactgtctttccgtttcctgccccgctgacgcgtacacctatttcagactcagcgcagctccgcggggagaaaagtgcggggctccctctcggctccacaccagactccggagtagttcgaactgcgctggggtcgccaagacgcgcgctgcccttctcccagcactgccctccccagcgtctttgaccactcttaatacccacaaacttgatcggacaatttctggtgtgtccagccatgtgtcacgtactgggaatacaaaatagaatgaggcaagctccctgacctcaaagatttcagagttcagttggagaaatcgacagaatctggggtttgcttctcacgcaagattttcaacagcctcaattggtctctctacttccgttgttgcatttctatgatatgttgcccgcacaacaatcaaaatgatctttttagttagtttggagctttggtttgtcaaggaattatgagtcaaccatcaatatttgaactaaaagaaacaaaactgggccaggcaccgtggttcacacctggaaacccaacactctgggaggctgaggtggggatattgcttatactcaggaattggagaccagcctgggcaacatggcgaaacctcatctctccaaaaatacaaaacttagccaggtgtggtgacatgcgcctgtagccccagctgaggtgggagaatcacttgagcccaggaaatagaagctgcagtcagccgtgattgcaccactgcactccagcctgtgtgacatagcaagaccctgcctcaaaaaaaataaaaataaaaaaaagcaacgaaactggatttactgtgtactctaataaggaaaagctatgctgggtcggcacagtctccccaagcagagctggctgctgatgctctatggagctttggggaatacagagttcaggaataggtgcatttcagaggcaaaagggtttgccatcacctgtagaagagtagatattctggtaagactgttattaattctccactgaatttattggagtgaacctgtcattggctgactttgagaaaggaggggtttttcaaaacaagttttactgaggcagttgattaattgaatgggtttaaaactggttctaggagtgtggaaacttgctttaattctcagggcttcaaaaaattattatagaaatgtgaaacctacagaaaaaaaaaaggtaaaaaggtaatgtacccaccaaactgagcatccagagaaggacacaggaaagagctttttagtcagtgccaactcccctgtgcatgcctgagaacttctccttgggggcttgcccttcccaggagttcaggctacctggttaccttgcaacccagctgtgtctgatggtttcagttaaggttgtgactttgtagttcatctgagtttttctcattattgagaaaggaaagatgttcattgcagcttttcatatcctaagcacaaaagaagtctttcgtctcaattttaacagtacattaatggggtattaccctttttctcccagtttcacagttgtcttttgtctttatgaagtttttggcttatttgttttgtcatgaaaagggttttttttagaatatagtcaaatttatcaattttttcttttattgcatctggattttgaaacataattagaaatcctttccttgtacccaggttaaagaagaattcacccatttttttttctagtacttgtatggtttcattatttagatttagattcctgacccatttggagtttattcttttgcctagtatgaggtatggatcaaactttttatctttttctaaatggctaaccaattgttaagtccatctttgtccaagtgatttgagatgccacctttattgcatactaaattcccatatgtatttgggtttacttctggactttcttttcggttgtactgctctttcttgtcatgcacaaggaccactgtttttattttagaggccttagaatatgttttagtgactggtagatgtagtcccctttcatagcttttatttttgttttcctggatattcttccatatttttccacctgaaattagtatcagcttgcctagctccataagaaaactggtatttttttaatgaactttgaaaattaacttaaggagactttagtttttaatgttaagtcatcacatacaaaaaaaaaaagtggtgttccagtttttcaaactatttcatgtcttttgagagtgttttaaagttttcttcatatatattttacaaatttcttgttaaatttattattctttgttgcttttgtaaatgtagttttctctacctttatgtcatgttactgattatgtatgtgaaggctgttgatttatgtatgttaagtttatgtcctgccaacttattgaattcttctctagtttgacttagttttgctgttaattttctgtgatattccaggtgtactgtcataccatctgcaaagacaaagagttttactcactcttttctagttctcctgccttcaattgatttctctttactaactgcagtagtgagtatctccagttcaatgttaaatggcagtgaagatagtgtacattcttcccttagacctgggataaatattaaacaaacagaagagaaaggaatgctcttccttgtaatagaaagccaatcaatacatgtagaaggaatgatggaaatataaaaccactgtttgctaggcatcatcataatatctgatccaggcaagaatcagtagttactaaaattagtggataaaagtttgaagtgtaaaggatatatgcataatctcaaagtagctcctcaccagagatttattaatgacaaaggaaaaaatagtgcagaagcctggcccacatacgtgaaccaagtgatcatagttaatactaccagtattggaacaaagtgacattatgtgcccccagatatgcactgaaactgaaaacacaaaactctgtgatttacctaacaaaagctcatcatacctaaatctcagcataaggaaacatcaaacaaacccaaattgaaggatattatacaaaataactggcctgatttctcagtgtcataaaagactaaggaactgccctgattaaagaagactccagagacataacagctgaatgcaacacatgatccaggatttctttggctatagggaacattattgggacagttgacaaaatctaagttctgtaagtaatttgtattctgtcagcatttattttctgattttgactactggactgtggttataaaagaaggtacctgtggccgggcgtggtggctcactcctgtaatcccagcactttgggaggccaaggagggcggatggatcacctgaggtcagttcaagaccagcctgaccaacatggagaaaccccatctctaccaaaaatacaaaattagccgggtgtggaggcgcatagctgtaatcccagctactcgggaggctgaggcaggagaatcgcttcaaaccaggaggcggaggttgccgtgagctgagatcaagccattgcaccccagcctgggcaacaagagcaaaattcagaaaagacgaagacgaagacgacgaagacgaagacgaagaagaagaagaggaggaggaggaggaggaacttgtttttagaaaacacatactgagatatttagaagtcaaaggacatgtacatatattagatatatatgtatatggagagagaataaaacaaacatggtaaaatgttgccatttcaggtgtctgggtagaggtatgtgggaactctttttactagccttacaacttttctgtaaatctgaaactatatacaccacactttgacctcctaagagtcttgtgcatctttgtatctcaaacatctagaacagggccagcttgaaaactgcttaataagtgaatcccttaaatcaggagcacgttacaccacctagtggtgtaacaaaggaagcttactgctgtggaaaaacctgttcctgtccacaatgaacttgctcattctaactgtgttgacctattattagccaaacaaattgcacttattttataattatcaagtgatgggaaagtgaaagcaatttggggtgtaagtataggctttatcatcttggacacaaggtcactagactgaccagcctggtttcacaggtgtgggggtggt

SEQ ID NO: 633 - DNA, 1896 bp, Homo sapiens
tttttaagaaaaaacatctattttgggggaagaaatttattgtgacaatgtattgtacttgacaaattttagttatcagttaagtttaatttctgatagaaaccctatcagcaactgtattaaaattttatacattcttggccaggcacagtggctcacacctgtaatctcagcactttgggagaccaaggctggtggatcacttgaggtcaggagtttgagaccagcctggccaacatgatgaaacctcatttctactaaaaatacaaaaattagccaggcgtggtggcaggtgcctgtaatcccaactactcaggaggctgaggcaggagaatctcttgaacctgggaggtggaggttgtagtgagctttgatcacaccattgcactctaggctggacaacagagtaagactgtgtctcaaaaaaaaaaaaaaacctttaaattgtattcatggtggaaagagttgaaatgtgaatggtcagtaaaaacttgtttcattttctaatcatattacctgctttaaaaacaaaaatcatgttgtctaatttcttattatataatggaaagaaaggtcatctaggatattagcctcttttaaaaaaatcttgttggccaggtgcggtggctcacgcctgtaatcccagcactttgggaggccgaggctggtggatcacgaggtcaggagatcgaggccatcctggctaacacagtgaaacccatctctactaaaaatacaaaaaattaactgggcgtggtggcgggcacctgtagtcccagctactcgggaggctgaggcaggagaatggcgtgaacctgggaggcggagcttgcagtgagccgagattgcgctactgcactcagcttgggcaacatagcgagactcgtctcaaaaaaaaaaaatctcgttattctacaaagtatatcaatcactccattaaatcttatttcatttaaaaacaatttttgttggagttcctctttcaatttgggtcaaacagctctttacgtgatgactttatgtcaaacctacatagagtttctggagtgggctccatccactccattaccatacctgagagaatgtcagatttcctgcttcctcatttgcatgacttctcaaagtcagcatgttgataatgacttatagaaaacagtccttttaaaaggaatggcttgctattggtttgggcaggaggcattttgaatgactgagcagttaagtcatctctttatttgagaataaatgatgaaggggtgtttgaatgggttaccaagttataaattaatcttgagatactcaaatgattgtaaaccacctgagctttcctctcagcttttaaatcatatgatatcaatctttgctcattttcctctgggtaatttgttattatgctgatggtaaccaactccatgagacattaaccggcaatccacattaccagtgagtatacattacagcactaaaataaaaataaactcacagaagaaatagcttgagatctcaaccatgcttttctgtctacaaaacggcatgacagtttggggatttctagctgaaaataaatttaattatgttactactttgctgctgctaattagtgcctaagatatgtatcaggagggcagcccagtgtaggtttcgaaagagggtttactacaaaggcaggatagcaaaatgggttacctttttcactctcactatgtaaagtgacatttaaattagatcctggaaattaccttttctgtttatgttagcaagatagtcttctcttttgctttattcaaatagggaagcaactttataacattttgtatcgcctacatgaagtgttttgcatatctgtaacctttcaattaatgttatttatgtttcaataaaccaccatgctacttt

SEQ ID NO: 634 - DNA, 3097 bp, Homo sapiens
aaaaccctgcctcgctagcgcagggagaagtcgcaccagtcggagcgcagagggacacgcagacatttcagcagaggcctcaaaggcagaacaaaatagtgcaaggagccgcacatccgcacagtgctgagaccctgcccaggacaagcttggtgagtggaaaacttcctttgtcagcccttcgcgcacttccagcctcagatcgaggcatcagggagggtttccttgaagagggtgggctgagggctgtgtgttcccaccacccctgttgcccttccatggggtggggcagcaagtgcttcccctcacctcaaggaagtgacaagggttgcacggagagctctccccacacctttcagtgtttggggaaacgtgaggactggtctgagaagtcagggctgccgtggccagtggtgccctgccccagagggcagtggggtgaaggtgtgtggctcccagggaccagatgggggcccttttgaataggactccacccaagtgggctgcctggaagggcaaagggacccaacagagatgtgggccactggaaaaccagagacccaagggctgctgagaccctgccccacaactacacacatcccaacctcataatgaaaagtgtagttgagatagggttgccagattttacaaataaatatacaagatactcgtttaaatttgaatgtcaggtaaacaacatgtatgtttttagtatatgttaaatgaaatatttgggacatacactagatctttttttatttttatctatctaaacttcaaatttaattggacattctgtatttttatctggcaaccctaagttgggagctttatagcagaaattcaagtggcttctccaagaaacccacaaaagcaccccaaagaaaagtcagccctagaaaccccaatggcagctcacaactgaagcagtcaagtaagatcatttctgctctgtcatcctggtcccccacctcaatgcctcatcaggatagggagtgggaggtggaagaagggaggggacaggaggaggagatgaccatctccatcacttcaggcttccgagccagagacgagacgctttaactttaaatgaaattgaacattttgattattacttggatcagacacagacatacaactactcttcttgtgacttaaagagacctatgatgtctgcctaagacggcatgtcttagatggggaaggaagcaggtcctggagctaggtggaaaagacagtgggtgaaaggagagttgcttcaagagtgtgctcagctgagtagcagtggttcccaaactgatggcttctttgcagagctgtctttctcactagcatcttagcatttgtttgtgtccccagttcatggcatatatagtagatgctcagtaaatatctgactgtgttgtttttttgagacagggtctcaggtgcccaggctggagtgcagtggtgtgatcatagcccactgcagcctcaaactcttgaggtcatgtgatccctcctgcctcagcctcccaagtagctgggactacaggtgcataccaccacacctggctaatttttatttttttctttgtacagacaaaaaagaagaaaattgggtcttgttatgttgcccaggctggtctccaactcctggcctcaagtgatcctcccagcttgtccttccaaagtgttgggattataggtgtgagccactgtgcctggccatgtctgaatgttgaatgttgacagcttcagtgaattgacccctctttcacctatgggacttatgaagagagaatctttctggcattgcataatccttcccaagagtactttagctgtggtaacccttcttgttataaaacatgccaggtatgatgatggagatcagctgagctggacttagaatcttctctaagaacatttacaggcactcagtgttaacagcagggcagatgtaggtttctgggaacctgaggcttataggaactggagttcattgtaagaaaaagaatatcaaattatgaagacaaaattaggcatcaatgtgaatattaatttaggagaaatcacaacaaatcgcacatcctgaaaagctaacaaatactgcatacatcgcagaatctagaagcataacaatatttgtattggttaacttggacatatcactatagtatgctttttttctacattttgggctatatttttttcctattctttttggttgatgtccttgtagtagtggctacatgttagtaggcactaaccctagtagtaactaatcctagtagtagggttcatgttattgttgtcgatgtctgtattttgtgatcaaatcaccaagactgcaaatccttctttcaacatattcatatgattcactccccttcattaaattgggttattcaaacaattatgctccaaatttatctcttcctcttaatcaagtactactttggcatgatctgatttttataattattctctcttctcatctttattatttatattttcttagctattatgattcttcttctcaatttcatgcttttgtctatcaggctttttagcttctgttgtgatagaacaaaagagtttttgacattttgtaacttcttccagtcttttatctttcagtttttgtctgagacttctactaggatgttttcttctcaacacgcttgatttttgtatagttaataattttgaaataaaggcattctcaagagcagttcaaatgcacttgaaaattgctgaaatgtattgagttgcatattgcataatcaaattacttttttgccacatagactgatctattggtgagtatgtgtaggggtttcattaccctggagtcctttttctttgctttttttcccctttctttccatttctgtggcaatttggtgaacagtttcatcaggaagtgtgagacttcataagggcaagaggatcagatagatactctaagggtgatccgttcagtttgcacaataaatctgtggaagacatcatatgtacagtggaatcttctttctttgcagagaaaagtggacaagcatccaatttccaaatcaattcttgggataaattggtataacttgttggaaagcag

SEQ ID NO: 635 - DNA, 1699 bp, Homo sapiens
gtatacatatgtaactaacctgcacattgtgcacatgtaccctaaaacttaaagtataataataaaaaaaaaagattctaaagaggaaaaaaaaaaaaaaaaagaaacgcctggggttttacgctgtcactccccagctctgagtgtttaggtaaacttacccctttgtgcccctgtttcctcacctgcaaaatgggcatgataatagtagctgtttcacaggatttatgcaaggattaaatgaagggatacatataaattccttacaaaagtgcccgactctctgtaattggtgggtctacatataagagtgttgttgcttagcacaatgcctgtcatatgagaaatgttccataatgtgagcgattactttgcttaatttattctcccccaactttttttagagtacttttggtggaacgttaaaagtgatgccagatacattttattgacatgcttaagtaagctcaattaatatgtatataatttattgcctctgccatgcctataatctaattgttcttttaaaggatgctgaggcgggtggatcacgaggccaggagatcgagaccatcctggctaacacggtgaaaccccatctctactaaaaatacaaaaaattagccgggcgtggtggcgggcgcctgtagtcccagctactcgggaagctgaggcaggagaatggcgtgaacctgggaggcggagcttgcagtgggctgagatcgtgcctctgcactccagcctgggcgacagagcaagactccgtctcaaaaaaaaaacaaacaacaagaaacaaaaaaaaaacttataacttcatcttctaataactatataacatttcaggaactatctttaggattaaggtgttataaagggtgattatatttcatgattatgttgttaacaattattatatttttattaattagtgaggattagagaaaagaaccccagatctaagtaaactaaagggaagtccagggtctctgattcttactctgatgcttattaactgtatgaactaagaaataacaggataatttgataacgaattatggattttaaaaatataattctgttttaagtgtagaagatggactggcaaggaagagatgaaaatagattggttagaaaactattgcaatagtctaagcaaggataaaacccttaactaaggccatagtaatggagatgaagagatggtacatgtgtagatccttgggccacagttaatcttcacaacttgccccttacttctagtggaatttagacaggcatagatccaaatggtggttttaccatttactagtcatatgattttatgctgcccataattcaatatcatcaagctttgttttattcatgcaatatagataaaacagtatctatctcatttaaaccattgcaaaattaaatgggatattctagataaagctccttttatagtgcctgaaacataacatggacttaaataagaaagggtaattattcttgattatgataaaactatcaagattctggatgtattttagccaaggcagagtaaaaagagaactgagacaagaggcagaaaatttacatttgaatcaaagtctgccactaaatagtggtttgatcttaggaaagtagagcctccattttctaatttgtaaaatgaagggcttgtactgcataggtagctctgaagttgaagcgatgc

SEQ ID NO: 636 - DNA, 1723 bp, Homo sapiens
aggctcagtagaattgcttcagacatgaaataaagctaaaatgaatttgtgtccaatatcattggcattagtgctcattactgttgtggtgtaatgcctcaaaccatctaaaatcaattttagaaactaaccaggctcaaaaccatggttccctttgtttatctgcagatctgtcctgtttaaggtaaaattcaccctgggccctcgcccctgacctccaccaggtgacttttcatggagacattctcactgccagcaatccttcaactctttccacagaagtctgccaggaagagaaatgtccaaagtccattttgagctctcagcctgggatttagctgcaatttttcatggacactgggcaattactggcatacgaagccaaggagaagcaagagagggaaggccctgcttctctagtgagatcatcatctttgcatcagtcactgttagagacatctctggtttctgttcccagcctaactgcacagaaaagagatattctagcttctccctagttacgcatatgtggagaaaactgaaaaagatgggtaatcatggttgttgtaagtacttgggggctccagaaggtgtccctaagaactccataaagaggggctgttgtttctctgagatttaaacctttagcacaaaatggatcacagtgcagctgctggaagtcatccgaaggagctgaaaattttccaagcccacaccctcaattgcaacttgtttgagcaattttattagcaaatctaaagaaataatgctttgatcagaaaggagagggtttactcagcatggaagcaggacaaaaaaagggactcaaaggcaaatgttagcagggactgcccaaaccttgtccaaaagagaaggagctgaagtcaatcgacgggtaatttctaggcctcttgaaagatgcatctccaatacggtgtcagaaatcatagatatcacaagtctgtaatcaacagatttcaaggattcaggtcccctttgggaagaacatcccatcctatcatggtgccacttaaacacttagttttcctgtctcaattcaatgttcaccaaaccttgtcttcaggttgccttgttgctgctgaacatttgccaacagaaagtagacaggatgctgacactgttgtagaccatctctgatagtgatttcttattaaaaatgtcaatgctgtgttttgatcttatacatacatgctgtgtgcctgctaaggaggcttcccacagaaaagctgctgctgcttcacctcagcgtataccttgacacagttgctatcctgaaagcggttttttcttaccattttaactagttttaagtgaccagttgagcggcattaagcacattcacattattgtgcaaccgtcaccaccagccatctccactttctaaccaccagccaagggctctcttcaccaccaagccaactctcagggcagcagcaatgtgtaccttatctttccaacaaggacattatttcattttatggaaactgggagagatgttttgtcttctgaagtatctggagatttcttcttcattcccagactctttcatcatcaaaactacacagcttctcacggtcacttactttgttaaatttgtagtttaaaatgaacataaggaaaactacttctccaacaaaggatgcagagttcctgttgtgctcaactctgccagatcgtgggcttattgacaataggtttggaa

SEQ ID NO: 637 - DNA, 2337 bp, Homo sapiens
agcccaggatcccttgcgccctgcggtagcccggggctgcccagggctgcgggctccaggcacccagagcgctgcgaccacatgaaaggcccggcgctcagcacccgccagccacctccagctggtttctaactacaccgccggggcctccatgcttctcagagaccagccttcgaagtgccgccttacacccggggcctggccaccgggcgggcgcggatggagctctggtccacatttgggagctcacagttgttcctgccagatgtggaagctgagacttaaagaagctatgaaacttgatcaggtcatgcagcgccagaggacccaaggtgggatctcaacccagactgtttggctccaaagctgaactgctacattacgttgcttcagcaaacagtcattcatcctgagagatgaacatgattccgcacagtgacttcagggtggcttattaaggggataaactcctccacctcttcttgttaagcatgtctgttcgacagtccaagcccaagatgaaaggcaagtggcatggctgaatcagcactttggtcccaccatgcctgccacctgttttattaagcgtgccagtgtgtcaagtgctgaggaatgaaaagaagggtgttgttgtcaaccgtgactttatcccctcactccaggccttccctcagccacctcagctggagaggccttgaggctgaggaaaaagtgccttccaggaaagcaactgcacacatttacctcagaaaataggaagcccccaagagcagtgaatgaaacattactttgctgtctttggaggccaatttccaggtctctccattttaaaatgaatgcagatacaaaatctcctcagtcccctgtagccgcgtgtgtcgtgtttgtccccttgggacagaaaatggtgagcttatgtcctgtggtgagcaagagccccccttgacctgaagtagcttccatccgtccctcagcctcccccttttcctttccagtaaagaaacccagttgcctggtacagtgtcagactttgcaaggctgttaacgacctataaaagtccaaagacagactactccagaaggaggaatcactgactaaggaaatcctgaatgccctaagcctgctcattaacaagaggcgaataataacagccaaagtggagaagctcataaattacccaaggaagcccaacgaagttggggggtggggcctgaccaatggaatccagggttcacttctggggttaatggaatcctggctggtccctgggattgcccaaggccaggcgtggtgtttccttcctgccttgctgggagaggtgtggaagtttgagggaggtgattattgcagagtcaccagcaaatcagggcgatacttgctctgggccacagagggaagtgggtcacgcactggagagtattagaactccaagctttgtcttggcgatgtgctcccagataagtaaacaacatccctccctttccctccccctactgggcatcttccactcccagtcatttatcacaggctgaagaaaacacattattaaaaagaaaaaggaaaggcggggaggaagacctaggacttctcaaacccctttccttccaagagctccaggctccatgctatgatcactatgagcttcccggacgggcttccacacccccagcaaactgggggatgagtttaatttgctttccattaaagctcctgctacttactaaagatttcacaacgtaatggctcagtataagcaaaatggaagccccaggcatgactcagcccaccttttcatgactcaggatctggaagaaattggagaatgtatgatcaaatctcgcctgtggcacatccagtacgaagaggtttcccaatgccctgatgtttgtgtctgtgtagacggtgatttcatcactccaccaataaagcctaacagtaccaacaacagcaaaagaatatggtagctgacccttatggagccttatccatcccaggcattaatagacacacacgtttcctcctccggccctcatgctaaactcaagaggaaacctaggctcagagaggtgacgtgactgcccagatcgcacagggtgagagccatggccaaactcggggcccagttccctaactgtaggactacaaccacattttggtgccatatttgatacaaactcaggtagaggttaagatcacgggccaaagagccagaaagtccttggagactgtcttggccgcatactttagggtgagtcactttgccttcctgagtctcacctgtaagatgggggaaataataccgtttgtgaggattaaatgagattcttcacataaaa

SEQ ID NO: 638 - DNA, 5478 bp, Homo sapiens
catgcacatctagatccatactttttgggctcaactcagggttaccaaaatagagtcaaactcaactcaggattacctaaatggagtcaaattttgtgtgtggttttgtaacatgattctttcagtcatcatttccaggccacatttttcatgtcactcatgactgcattataagtttgtaccataattcatttaaccaatactctgttgtgcatttagaatattttcagatgtttattgtccttataaaagtcagtatgaaggtatgcaattatcacttaggccacattcctggaagtaaaattgttggaatggaaactatgtacattttacagtgcagattgctggaagagttttatgcaaaaacttatacaaaaatttacactcttaccagcagaaagcctcagcgccactgagtgctgttgtattgttaatcttgattaatctggtatgtgaagaaggatgtttcaatgttttgtctgtgtctctctgattattttgcttgttgattggccagttgttaattctgtctttgtgagttgtctttttctcagtacttggcctatttgtctttgatttgaaaaagctctttatgttgtagtcattttaattcctgtcatatgttttgtaaacaatttttcgagttcataatttttcaatcttgtttgtattatattttgccacacaaaaattttaaatttgtatagtcaaatttatcagtctttttccttatgttggaccttctaatctcaaggtactaaatataatctagcatttttttaaacattaaaaatttttaatccatctataatttattttaggatagggagtgaggcaggggaaggtatctttttaaataaaaatcgttgctaaatggttggctagttgtcctattaatagtcattgagaccaggagcggtggttcacccctgtaatcccagcactgtgggaggctgaggtgggaggatcacttgaggtcaggagttcgagactagcctgggcaacatggcgacacacaatctttacaaaaaataagaattaacagaggccaggctcagtggctcacgcctgtaacctttgggaggccaaggtgggtggatcacttgaggccatgtgttcaagaccagcctggccaacatggtgaaaccctgtctttactaaaaatacaaaaattagccaggcgtggtggtgtgcacatgtagtcctagctacttgggaggctgaagtgggaggaccccttgaacaggggaggttgaggctgcagtgagccatggtcatgccctgtactccagctgggtgacagagcaagaccctgtttccaaaaaaaaaaaaaaaaattcattgactgtttttttctgttagtgatttgaaatcatatactgaatcatatgctgaagtctatttctgaacttcttcttttgttctactgatctatttctgtgccaataccacctactgtaactttaaaataggtttttgtttataccaagtaagaataagttaccattatttttccattaatttttttttttttttttgagacaaggtctcactctgtcactctgttgcccaggctggagtgcagtggcatgatctcagctcactgtaacctctgcctccctgcttcaagctattctcccacctcatcctcccgagtaactgggactacagatgcgtgccaccacacctgactaatctttatatttttagtagagaggggggtttcaccgtgttggccaggctagtctcgagctcgtgacctcacgtgatcctcccgtctccgcctcccaaagtgctggaattactggcatgagccaccgaggctggcctgagtattctagtttataacttacaaggtcattcatatgtatatgttgttgtgcttgtctagctattttatattttgttattctgaactcttggcctctatctcagctccagcccctgaaagtgcaggagtgcttttgctctgccagtcggccttttttgggaaatcatatcaagatggcttttccagcacaattacttcctagagtgtctgcttgatgcatggaaactcatagatttttggcatgccaaacagagggttttcctgccgtcactgctggctccagccacagacttcagttttcttacctgttagagcctttgtcctctgactggtggaaatggagcttgcttctttttgttttgcctgccactagtctggcagcctccacctcttgacccttgggtttcttatccttggaatcagatacgaggccctgtgtcttctgttgctgtagaggacacaagtcatattctctgagtggagatctctctgaagctcctctttccaggcttgtactgagggacctctggaccctctaccacgtggtgtcaaagctgccaagagctgtcatatgctgggtctgtaaattgactttctcacctctgaccagatgcattcacttgagcggcacagagatttgggggagtgaaagggcactgtttctttgggtccgtgggcttgtgtcccatcccctagccttggggttagcaggattcagaatttatgagtgtggtctgcaaaagtctacctctaccagatgggggagaacctagtgtgtggacctgaagggttagctctgtgctttagtccctgggagtggccatcttgagtcttggtgggcttggcaagtaaggagacattgaccagattcaaagcttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaaggtcctggctagagaatgtcaatgtccacactgcatgtagccctatcgaggagatgatgtagggggctgtcagccttggagactctagcctaagtaccccaccaccactctggctggcttccaagggcacaaatcagctttctgaatctgacttggcttcctgtgatctgcattcatgaacattcttactagagttctcatggaaaatgaatacacaactatttggtctgaatgtgtctgagtttggtgtctccaaaacaattctctggattagatggagaatgaagaaacttcacaaaggcaaaaggacaggtccccatctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatgagaaccggagattgggtccaaaagagaggatgcccagccagactgaactttcaagtgttttccaactggaaagctccaatgtcctctgatctcagtgaatttccaatctaatttcaaggaagtccctcaggagccccattgcaagggtggttatagaaccatttacaactgctttaataaaactaatgcttataaagaaagaaaacttgttttttagtcatccataacacaaaaaagtgaggtttgatgcacagtaaaaggaatcattatttaagttagtctgagttatattgtattttggaaatgctccacattcaatatttatgccacatactctaaaaccaaagtatgtagattaaaaaaaaactatttccagaaataagcttgctgaatcaccacaggcttaatttatttattttaactaccagtttcctgaatgtttttgtctaattggcctatctgcagttgcccttggtccacccttgagcccactctttaagcctgtctgtcacttagagaagtacaagtacttcctgctgagaataaagccttgatcgcaatttcagtgaattatcagggaagtgtgagaataagtaggaataaatgtctaaacatttgggaaaaacttgtttgcaataaatgtggttaacagagagtgaataggcttactacataaaattgttactcatcaattaaaaaaactgtacaatcctcctccgggggaaaatgatcagatattttaagtctgctgatatttttctctggatgtcagacctgtatactttgtcctgcattattggagtataattggcaaataaaagttttatgtatttaaggcatacaatgtgatgatatgatacacctatacactgtgacatgattacctcaatcaagctaattaacacatccatcacctcaccttttttgtgtgtggtgagaacacttagatttactcctatagcccatttcaggtatacattattaactctagtcaccatgctatacattagatctccaaaacttattcatcttgtaactgaaagtttgtactctttgaccaacattcgccattcctccccaacccctaactttggtaaccacccttttgctctctgtttctatgagttcttctgtttc

SEQ ID NO: 639 - DNA, 2409 bp, Homo sapiens
cgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaaggtatacctgtatatattttggatgactattctgatgtataatttctttttcttactttaagtggttgaaa

SEQ ID NO: 640 - DNA, 39996 bp, Homo sapiens
aggccgccctgctagggccggagggaggtgggcacgccgggctcgggaccttcccggggtcctgcgcccgcccggcctcccgccctgggcatggttggcccactcctcccgcagccaccaacctgacagcccccgagggcgactccgccgacagaccgccatgcaccgggccccgccaccagcgccggccccacaacccgcctgcgccatagcccgcccgcccgcgcgcagcttgcctcgcgcgatatccaggttccagggccgccgcactttcctttcctcttggcgcgcctctaccgggccccggaacccgtatagaaaataccgggcacggtccaccccgccccccgcttcgccgcggcagccatccaacttatcctggttccggggctcctggagcccaggcggccgggatctgaaccgagctcttcggagccccgcccccaccaaggccggggtgacgcatggccagcgaggctgagcgcccagggaaggcgtgctgacgtcacgacgcccgggtcagggcctgggcgcggctcggagccgggtcgtcgctatagcaatcgggaaccgctacctgtccattccaaggattcggtccagcagaagcgtgaggaggtggcggaggccccgagggctttgcgtcatcacttctgcggcctgcgggcgagaaggtgcgcttcgggagtagcgcgggaggacaggaggcgcaggttgtgagggacgcaggccctggggcttcggtctctgtcctccgagctcagagcctccaggcttcttcccggccgcgcgctcagcactcactgtcttacggtcccgaagcgctttaaggtgcgcagtccgcaggccttgcctactgatcttccagccaccccttgaaggaagcagttgcaggtattaagagctccttattgaaaaggacgatgtagaggggcggtgagggactcgcctccgcagggagggcgccctggcggtcttctcaggttctctctcattcccgcgtcagctccaccgtcaggctcgaaaccgactactcccttttgtaggcttgctttgggttgaacataaaaaccaagcccctttactatttccctgctgggaggggctgcgattgggaaattttcagaaacctgagggaaaattaaaagggagcgagctttcggtaaaaaatcaaattaaaaaggaggggcgttagagaaggaactggtaaagattgccttttaggagaggaactgggtggctggaagaatgaggtgagaaactttcccctctctatcctttcagactttaactggtttcttttgtatcttccccgccccgaaaacaatttaacttaataagaataatttttaaaggacgtaaactagacacagttacaaagtacggggtttggggcttgtggtagctaaaggtgtctttggggatgcgggcatccttttcctctcctgcctgaagagcttaactagaaagcccccctttcggtcttagacatcccctcttcctgacttgttctggctgggaccagagttcagtttaggtaggccagtgagtgacatttgatggttagaattcctacggttagaattaatcccttctgtatctcctagtatggaaataaactgcctggccactatgctgccctctttccattcctttttggtggaagtttgacaagttatttcccatagaaaataacttataggccgggcgccgtggcttaaacgcctgtaatcccagcactttgggaggctgaggcgggcggatcacgaggtcaggagttcgagaccagcctggtcaacatagtgaaaccccccctctctactaaaaatacaaaaaaattagctgggcgtggtggcgggcgcctgtaatcccagctactccggaggttgaggcaggagaattgcttgaacccgggaggcggaggttgcagtgagccaagatcgcaccattgcagtccagcgcgggcaacagtgtgactccgtctcaaaaaaagaaaaaaaaaaagaaaaagaaaaagtaccttatagatacagagagaagattaagtagctcctcttataatatgaattgagggttagaaataccgcagggaatagaactcaggctgtacctgagtttgtccctctccaaccaccctttttccatagctctctctgtatatatatatctgtcttttctcacattccttacggatcgtaatctgatggccagtcacctctgcaattatacatttaacaagagctctgggaaacagtgtctgaatctgaagtaatgatcctaatggaaggtaatttcaggttctcaggagaattggtgaggatattttggagggcagtattgaagaccattgctagcagtttctctcctatcccttccactcaacatataggctggtgatcttcagacattttttagaatgaacccataaaagaattttgaagagctatgtacctcttgttcatttttaagttgatacctaaattttccttcattaatttaaatacttatagaggatacaatttcaaattttgacatcttaaactaagacttacatcattctttttttctgagacggagtctcgctctgtcaaccaggctgagatcgtgccactgcactctagcctgggctacagagtgagactgtctcacattaaaaaaaagtatccggtggattccaagtaccctaaaaatctaatgcctaccatcatccacttaaaaatatatgaacaagctcttcaacagaaattttatatggttctctttctccttatactttgaattccattcacttcctgtaatcattagtatataacttactaaactttttttttttactaaatattactaaatactaaattttcctaaatatttttaacatttttatgacttgtgaaacctaaaaagtacaatttttattgaaaatgcatctgttaatgagaaatatggtgtttctccccaattagttcaggtattcatggattaatattacctaatggtagaaggagataaggtgcaacatcaatcctttacctgttttttatttttatagacatgagtattgagaaaccttgtttccacaattgggaaaggaagagatttgttacaatgatattctttgagtctttgaacttctaaattatatgccaacaatcacagagtgatctattaatactatcaaatagagtcttcttttaattttgttaaaagcaaaggattagaaaccactgaacttccaaaaggatttagttattagagtctcagttttggttttattaaacatgattattaattatctgtgacctttacactcagagacactttgttaatcagatattgatttccatacttctttgcctacacaatattttttggtaaaattctttaattattacatgtcttcaagaactttttgttaaactgaaatgcagattcagctcattcactgtatagaaaacaactgccatttgtggaattggcaaagccagttttcatttcaaaccaatcagccaaatcagacctactttctgttagaaacatgtctgactttattcttccattcaaataaatatgttaacattcattttgaggaatattataaaaattattaggaaataaatgattaactatagcttataaaatggaccactgataaaccagtcaagattaaaattatttagacctactattaacataataaatggtaaaaataagatagtactgtttttcattatataattaggaataatgctgtataatgtatagttaaatccatcagttttgagaagtcatatagaaggcatatattcccttggtaaatgtgtgtgcctgctttcatcaaactcttgttgttcagcttttgggaacaattaaatgagaatcatgtctaaaaatcagaaataactaataatcttgttacacaaatttttttcttctgtattttttagaaaggaaagctgtatttgctaagaaataatgaattgagcagctagcaatttcactttttactaggaggtagaaaataataaacattttatataagataaaataggaagactgattgcaatgggaatattttgatatgaagtggaaaataattgctccctccaagctcctcaggtttttacaccctggaccatgcatcaagattcagtgtaggggagagacattcctttcttttgtaaagtaggacaaggactatggtgaaagtgggggcagtggtagagtggagaatgtgcatgaatatgtcagctggctcccaaatggattggtttttagaatttttttttttttttttttttgagacggagcctcgctctgtcacccaggctggagtgcaatggcatgatctcagctcactgtaacctctgcctcccgggttcaagcgattctcctgcctcagcctcctgagtagctgggattataggcgcgtgccaccacgcccggctaatttttgtatttttagtagagatggggtttcaccttgttggtcatgctggtctcaaactcctgaccttgtgatctgcctgtcttggcctcccaaagtgcggggattacaagcatgagccactgtgcctggccgttttttttgtttttgtttttgttttttgagatgaagttttgctcctgttgcccaggctggagtgcagtggcacgacctcggctcactgccacctccgcctcctgggttcaagcgattctcatgcctcagcctgccaagtagctgggattacaggtgcctgccaccacgcccggctgtttgtttttttttttttctgagatggagtcttgctctgttacccaggctggagtgcagtggcccaattcagctccctgcaacctccccttcctgggttcaagagattctcctgcctcagcctcccaggtagctataattacaggtgtgcactgccacacccggttaatttttgtatttttagtagaaatggggtttcactatgttggccaggctggtctcaaactcttacctcaggcgatccgcccgctacagcctcccaaagtgctgggattacaggtgtgagccagtgcacccggcctggttttagaaaatattttatagggaagttgaggatctggaaatttattcctttaaaactctcctcagactgatttgaggctatttcctgggtattccttgcagtcttacgtaccctaggaaaaatcttcatttaccccacttggaagacttcttaatataggcatatccaaactccaatgtccctgactatccattattttgagacaccaaagcaaatgtcctacgaagtaaggaggaagacgtgttgttcttagaatagaagtgagttatgagagaagtcaaagaggatggctccaagttggtatagtgtgaaggtcatggatatggtccttggctttgcagttctagaagtgtgattttgggtcagtccacacaaaggtgttcatgttttgtcacattaaatcaaactcataggaagttaatgtacataatagaatgccagtgcattcttttatacttacagccaccaagtgaactggattatcgctcctgttgggtaaatcttatctgggaagatcaattataatcagaaagttacatgaggagtgtggatcttgagcatggctattgtcaataagctgatgagcaggtgctcactacctggcatataataggatctcagtaattatggaatgaatgtacttcatctgtatcttcattatagatgctaaagggtaagtttaagattctgataggccaccccacatgttttttgatcaggtagatttttccttgttgctcaagttatactcttaaatggctatatcatgtagatattaaatccaataaaatttcatgaaagggaattatataattgcaacagcaaagttttatctatatctctgagcctagaaattgggactgttcatttataatagagattggagattgctttctcctgccctgtaggagtagtgatggtggtagtgactaaatgatctgtatttcacaatactatttggtggctaagagtgtactgcatacaaagaatgacactgggtgaccctcagtgctggcgctttcctagaggtgggacatcctgagtagggaggtgctgaaccacctgtgggctggccagctgttgtggactgtactgtggagaggaggaacaataaatttcccccactccttagatccccctcaggagataatacttgatgctgcttttaaggacagagaaaagacaagccttttcaaattttaaaatcattagggatgagttgccaaaaaatttgggttaagttttatctggaagccagaagacattgtctcctcaaggctttttctggctctgggataagctattgagatagaggaaaagatgccgggctgaggagtttcatttagtattttaataataataaaaaagacatacaaaatccaaacatttctttttacaattcagatacatatttttccccaagtgcaaaatactctatgaactgcatcatttgctgtttattgtcgattgtataggagatgcttactaaattggcagcagtggaaggcagatataaatacaatattttgaaatttcttctgcatttaacaaaaagcctcccacatggcgatgattattctgaaacttgagttcagctcacacagaagtataaagttttcagtttgttcaaactgctacaacctgtggtgtctaaaaaagctgatgacaactgggggttctattccttctaatcatatatttccttgtacaaataatggcacaaggatagggtgtgctacttttgagacgggtcaaatgtaaaaatatccttgtgttgttcgctcccacttttattgtgcttaagaaagaaacctggagggttaacattttctgcttatgctcagttatactttgtcttggtaccccttgtttgtggctgtaatattgaggttaagcagcaaatacaaaagttcgagtgctctataacgttttctgacattttgagatatgacctcataatccattccagagtcacctcaaacatgtatatagagaacacttctcatataaaaagtttctctagggccaaagaccaggactgtgttactgaactttcagcaacaaatctgagtctccaccacctcaaactgaccaaatcttgggggctgttaaagcagtcacagctcagtgccagcctttggggatttctaggcctggagcaggcagctcagatccaggatctggtcagttttcttctgactccaagagttgtctcaggttgtaggaataggcatggcctgataatatagaaagagggaggcagagaagtaaagaggaactgccatgttgctgaggatataagtgcctttctggtgtgcattacttggtgcgtgaagccctcccatttccaggctcagagcaggtgaggttttgtactaagatgaatggaagccccacaatactgtcgccccacaccctacacgctgcagagaggcctctgggttgcttcatgaagggatcctatttataccatctttccatttccctccaatggtaaaaacctctcttctgtctgacctgtaaagacctagaatgtccctgagcgttgactcctcattcaatccagttaacccctagtttgatgtcccagggccagcctcctccatagattcagcagcagctttgcctgggttcttaaccctccaacttggaggacctaaattaaacttggtggacaatagcaggtttttacctgctcaccaagatctgccttgacatcaattaagaagcctagtggtctatgccttccgtactgtggaactcatttgcaggtctcataagccatggaataaatggttgaaggatgtgtatttgtatgtatgtatgcatggtgtgacaggaaaggaagggagaaaggagaagccagaccctgaaggcataaattaagaagcatggtcaccgtttggctttccaagagacgcaaaacggctggcagagaggaatcagaaagttatcctaggctgggcgcggtggctcatgcctgtaatcccagcactttgggagactgaggcgggtggatcacctgaggtcaagagttcaagaccagcccgggcaacatggtgaaaccccatctctactaaaaatacaaaaattagctgggcgcggtggcgcatgcctgtaatcccagctacttgggaggccgaggcagaattgcttgagcctgggaggcggaggttgcagtaggccgagatagcaccattacactccagcctgggtgacagagcgagactccatctcaaaaaaaaaaaaaaaaaaaaagaaagaaagaaagaaagttatcctagcttctggtggagaattaggatagtcagagttgattaaagcagttttcatggtgcttcctgggaagtacagagacactcatactaaatgaccatttcccttgtttggaagcagccattttgcatctttacagtggccctccttgacccagaaagacaaaggtagccagacactctacccacaaggaccatgatgttggctaatggttgtcagggaatctagctgtgtcattggctacctactgctatggccgttttggctgatgaatgctactgatgggagggcagggagtcagactcctttatttagtgttgagtctcctgggggagcagtagcctaggacagtcacctagaaatgaacctgagctgttctgtgagttaccaggagagttaaaaagaaaaaaaaaaaaaaaagaaatgaacctgaggactcagttggtagcctttgattgattgggactacagctttgggggaactagagtgagaaaacagaaaataattttataggcaacacttggattaagggcagaatgtgtgcaggctttgggcttgggcatggacttgattcttcttccatttgattctttcttccttctgaaaaacagtagttgaggaagctaagcttgaagtcaacttcaaagggaagtgaccagagccaggcaaatatctgatgccttctgtcttattcttggctcccacagctttgtctctggcctcgggaccctgagtcagcccatccccaggtggtatgtcctggtcctcttccatgtgtacaccaggggataacaggatgaagacagggaaaagatggaggttttccctacttggggtagagaatcactgaccagttccattggcctctataatcatgaggtccacactgactccatggagaggcatagggatagcaagattggtttagcaaacataggtctctctcctttctgctccatcaaatccccagaattactttcctacacatcagatgcctctgcgcaattaccctggattaccacagccaagggctctaggtggccagtggtggcatagagacagatcagatgctccagcactcaaggttcatgagattcaaaaccgattttcttccactccaaacatacactcttttctcttgggcagctataaatagggttttgctaatagaggaagaagaaacaaaaacaaaaaacaaacccagaaaacaaaaacccctccgtctagacaacatagaaagactcaaaatgattgcacttattaggtgtggacagggtgggcaggaggctcgccaagtgcacacacattccttttgctgcccacagcctgaggccagaggtaggtggctccaggctggcttcagagtggggtcctctttggtgaagcccacaagccagctggggctacaagggaaaaacaactgtagggcaaggcctaggctggcttcaggtcaataaccatgtttaaggacaacatgtagcaaggggagtagggctcccccagggagcatcacatggggctgaggaggtggctgggccagggaagacaagaaaagggattagtgtttgaagttgacttccaattgttctgtgtctagtcctttagatgatacattttttctttctgttttcttttttttggcaatgctttaaaaccttgtttctgtcctgcagagttacagtctttctctcagggagctacagcggggcattcaccatgacaatgcctgctgctcttcctcatttagccggtgtccactaactcagtgttgtgggccatttgtaaacccttatggagtagaccccaggcagacgtagggaaagaaagagaggatctgtatagacaagaaagctggccatgtgggaagtccagagctcaaaccatgtgccccagaggactggtgctggcattaagcctgtaaatcaaaggcttctttggcaggaccctgggctgttagaatcaccctagggagcagagccaggggacattttggcccctgactagcaaggcacaaccctataatggcagaagcccttctttcccctccccgtttcccaccagacccacttccttgatgggcctctagcacccttccaagctgatggggtcgggaatgtgagctggtaaaatgggcagtggaaggggctgtactgtttctttacatctcacggggactagagccagtactgaatggcttttctaggtagtgtgttagaaaagggggaacagtagagaggcaggcagagagagacaaggaaaggaaactagaaagacagaaagggagagtgcctggtttgtgtagtgatattttttttttccctccaaaaagagaggagagagttccttgtctgagggtagggggctgccggctctgagggctaaggagtctgggggcttaaaaaattgggtctctgagcctagggttactatttgtagggcctcaggaagctggaaactttggagcggagcagcttgatgaaggattttggcagcatctccttgtgtttctctgtgtacttgaagtagttctgggggtgggctagcacctcaaagaaggccttgatgagcttcttgtcctgcaaaggatggcagggagcaatgtcagcctcaccgtcgggggtgggaaagagaaacaccatgactcagcagcccttcttgatgtctactaggcatcctatactgaatatatccagagggcaactctggattcccattcccaccatctgcccttattctggaattccacaactgaatcagtggcagctccatccttctgttgcttaggccccaatccttggagccatccttgaatcctctttcttgcttacaagtatagcaaatcctattgactctaccttcaaaatatgtctgggtctgaccacttatcatcttcccaagccaccactgtctctgacttggagtactgtagtagcctcctaactggtctccatgctacctttgtccctccgtagactcttctccccacagcagccagagtgactttttgtgtttttaattagttcatctttttcctgtttgaaactcttctctggtttcttttatcactcattggcagaatgtgatctgtatcttgctttccacctccactcttgctccctctgctgagccacactggccttctggaggttcctgaacacactaaattgctcccatgctccttagcttggaatgctcctccctcatcttctaatggggagcccttttacctcatttgggtctcttctccttagaggcctttcctgaccaccctgtctacaacagtagcatggtatgtggagagcctactaggtgccaggcactgtgcattaaaactcaggtcttctggctcctaggctggtgctccttccatggcgtcagtggatttttcaaataagaagtaggggtttcagcctcttaccccactttaatcagaacagctgcactgctttatgtgttggaattccacagtacatttgatttgaaataagggttcagatgctttaaaaatgtttgaaaagtattattaaaagtatattctttgaagtctgcaagttctaggtgatttttgttgtcaaggcttttattttgatgataatataaaaatattttgctaacacttaacttttttgcagtgataatttatgaaggataattctatgactacgactatagtttccttttttttttttttttgagactgagtctaactcttgttgcccaggctggagtgcaatggcatgatatcagctcactgcaacctctgcctccccggtccaagcaattctcctgcctcagggtcccgagtagctgggattgcaggcgcccgccaccacacccagctaattttttgtatttttttagtaaagacggggtttcactatgttggccaggctggtctggaactcctgacctcaggcgatccacccgcctcagccccccaaagtgctgggattacaggcatgatccaccatgcgcagccagactatagtttcttaaggaagattttcttaaattgggattcaccgacccagggcatctagtccattcttccatgttggaagtatttattttccttgaaaagaagtctgtacataaattgattctgagaaagctgtgctagatctgccgctgctttttttgtttttgtttttttgagacagggttcactcttgtcacccaggctggagtgcgatggcgccatctcggctcactgcaacctgcgcctcctgagttcaagcaattctcctgcctcagcctcctgagtagctgggattacaggcgcctgccaccgcacccggataattttgtatttttacaaaattaagacgaggtttcaccatgttggccaggctggtctcaaactcctgacctcatgtgatccacccgcctcggcctcccaaagtgctgggatgacaggcgtgaaccaccacacgcagcctatctgctgctgcttaatgaggcctggggagagaataggggaaggaagggacttatgcaaaagtatctttctatacttcactttccctatgtctcttggaagaggtagggacatttcttctcctcactttccctttctcttccaagttttccccaaggtgtaatatagtgtgggtgacgctgcagtcggataggcttgggctcaaatcccagcttcccatggggcaggttctttaactctctataccccagttttcccatctgtaaagaagcaatggagaaagcacctacctcatagagctattgtgtctatcaagtgagaatattcatgtaagcacttagcctattgcctatatattgttacatgcttattaaatgttagctatcattattgttaatattcattcacctttaaaatctcctggtggttttcagaggcatagagccggccatctcgcacaatgtcttctaccagctgctcatagtcctctgcaaagtcaaccaaggtgaggggctcaggggcgggagctcttcctgctctcctggttccctctcaaaactgacatacctccccttctcacccacctccttggcttaccatcataggtaacatagggaatctggaagccacgggcgctgttggcctcgcttgtcttgaagttgatccagagcttcctggaacgggcagtgaaggcaatgggacgctcgtaggtctggcaggtcagtagagcagcagggcaggctacccaagccctcctagaacgtgggctgtacagctggtggtgggggtatagggcaagagaatcattctgacaaaggctcccccttcgcatacacacaccctaccccacaccctctcccattgcccactgggctcattccacaattcctccttgatacctgggcactcacatagtgtaataaatatgacatttaaatgaatggaatggcaaaaatgctaggataggaaagtgatacatgtaacgccattggagttctagccccactgctagctttcttaactctgttttctaccaaacatgtgtcattgctgttttcctttgttagcttctctcttcctaaaggcctctcactatttcaccctcatagatccctaacttcactgccccatttcttcctgtatcagtctctctctttgttctccgccttaaccagatttggactgcccttccctggcccagctctgcaagccacccacagttctttctcatgacgaggacgtccccacactcatcctcagatggcaggaagatctctggtaccacgataaggatcttgcgcttgggtggggggttgatgttccagatgcactccacaccagctgggtagttgcccgggtagttgggggactcaatatagccagtgaactcacccagctccccaccacactgacgatctgcagccaaaccccagtggataaaacaagacagagaagggaagtcagtggggaagtgtgctgggggaattgaagagttctgaagtagaggtcagacatttatgggaagtctgcgttctagttcatcattattttccaagctctgagtccatcttccttcctgcccttttagtaccttctcttctcacttcacctgtctctgcttcctcattaactgtctccagggagagggtgttacagggtccagcctagcaactggccttgagattgagtgagttggggagaggtggaaggtggagttttcctgctcctccaccccccagccctgctccctgttggtttcacacccctcctttagatgtccactgctcccaggcctctctcctcccttttgcacagcctggcttgccacgtactcttgcattgggccacactggtagagccatcaaagtctgtgcttgtgtttcctggacagcggctgcagaagttctgacggaagtcgggctgataggagcccatggcacagcgaatacagcggtggatgctggtgttgtagtagtgccctggggagcactggactgtaggcaagggagaagggcaggaatcaagatggtaggcaggtgggagttacggggcatgggatggacaggatacattcatcctggagaatcaggagatcagatacatcaaagttcttttctagggtctcaatctttcccagtcatgccagaatttaagcccacggaaaaacagagtttacagagtggttggctacagtgccaatccttttctttcagacgctgagcacagtgccaaacctatatagaaactcatttgggatatggaggagaatatgccaccagttctccaaagtggagaggtgaagccatgcctccctttccctcacctgtgtaaactgggtatgaagacagaggacaccaggaaagaagccagagaaagaggaacagtgatgaaggtaaggatggagattggtcacattggtcggataggtaactgggggttgcagctggttgcaatgagcagccagggaatgtaggaacctgggaagtggctctgggtgcaggcagagctatggccatggtgctgaggttggaggggcagggtggggaaaggcagctgagcctcacctccttgtggagcagggaccatttctgtggacaggccacagccctgtccttcctcccctcccccctgtgcctgggcttgctgccatattccctagcctttctcctattttggcttaacaaaacaaagtctgacaacttggcggggagggatctggggagagctgccaggccacaccctagatggtgggggtggggggcagggagaacagtaggctctcacccccaaatcaccacccctaggttctagagccaagctcaccctggagcccccaattcaacaccttgattccatctctatgctagctactgccctcccaagtccatggcccttctcagtttgccttggcccaggaggcatcacgtagattggttgtcaaatggagcagctagaatctgggctcctgagggcttcatctgcccctctcttcccatcctctctgctgagatcctgcaaccttctcttccccttctggccagggcagagaggcccagatccagctggctcttgcccaagagatgcacctgttggaagagctaaggtgtactttcctgtgctttgctcctgtctctaccctgtcttttgctgttctcttgacttctccccatccctgtcttcctgctcttgccacattctacatgccatccttctgtctgctcccttactatctaaccttgtggctttgctactctagccaagctctttcctccaattctcagtggggaagctaaggcccagagcatggacaactttctcaaaattcccctaagagccaaaggtagtattgagactttgaaccctaaccctaggtaatctttgtcccttgaccctctctatacctaatcattctcttgtccctctggttggttctccccaaaacacttatagggaaatgagatgtggtgacaatcaggggcctagaaaagtcaaaggcagccaaagaactcagaagcttatgtgcatgtcctgtaggcaactcactgtcctggtctaagtgccacagcttcccttcccaaaggagtttcataagaggccctcaagggtgactgggcagatatgaggcccttccctggaagctaaaatggtaggagaggtgaccagggctgggattaagggcccagcagatatcagggtttggaggccagggttgggtgtagaaacctatagcctgggtccaatgatgggttatgactaggtttggaggcagctctgcagtaaggaggctcttctcagccaataggacttaagagaattcatctatttggtcaattggtgggtgaggaccagcccagcctgcttttctgggcatcattccttttgtttctcttcctttcctggtcctttatgcttctagtgcctgttttctgttgtggctacagggtgaagtaatttgggagaaggccctgggttcaaatttcaaatccttttctgctatgagcttcagattttctgcttggggaagagtctgacttggtcccagtaattttccaaaatgacagagaccaaagttgagttcagttccttagagattctcttatctctgatccagctcctgggacaaaggagatcagtgaggagagggtgagactggagattgcaggaagaactgggagaaaacaagcctgtaagggtcagaggcttcctggggcatagggatgcactgtcgtcatcatcaaaaacattcttcccattactgagctcctaccatgtgctaaggattgtacagggctcttttcatatgttgtcttgtggtgatccgcacagcagccttcaagtgggttattaccaccccattctattttattgttattttttgagataagattgctcgatctggagcgcagtgacacaatcacagctaactgcagcctcgacttcctaggctcaagccaaggaagagctcccaagtagctggggactacaggtatgcaccatcatgactgactaatttttattattattattttttgtagaaacagggtctcactatgttgcccaggcctgtcttgaactcctgggctctagcagtccctctgcctcggcctcccaaagtgctgggattacaggtgtgagctaccacacctggtcccacccccattttagagaggagaaagatgagatttccagagattggctgatttgcccaagacccaaggctagtaagcagcagaaccaagatatctgtgtggagccaaatcagcttcctaccatgcctcaccactggctaaacccactattcccatctcctggcccttgccctaggagcatttcgtagcagcttttcctctaatgtttttcatccagcaggatttttcatcctaagtggccagtctcaaaggggaggctgaccttattctcttgtgaatgtagctcttcttgatcactctctcctccttccctgggaaataggaaatgctgaaaagatctctttctccacaagacatccctccaccaaatcccctctcctttgcttacccagacagttgtgtccgtcatgtgccaggtggaatccatcatagcaggtacaccggtaattgccagggatgttgacacagtcatgcacacaacctgcattatcctctcgctcgcactcatccacgtctgtgggcaaagggaagctgagacagctgaacccacctgcgaacccactgtccacccccagactcagccttatggttgtgtttacatagttatgttcatggcctataagccatttagcatttttctgttttcatttaaacctaagtcatgaacattttcaggtctccatccagtctttctaattaccattgtacatggttgcagaatattatttttctatttttttctctattgttagagatttagatttctttaatttattttaccatcatagataatgcatcaaagaacatcttctcccatgtattattttgttactttgaataagtccccaagagtaaaattcctggatcaaaggaaataccttttaagattcctggtaggtattacaaaattacttttcaatttataatgcaactaggaattaacaagtgtaccctgtccactaaagtctcaccaacactgaagctcataaatttaatatctcaaggctactttaatttgcattgatttaattatgaggggaagatgtgtttacattatgaacttcctctgaagcacactttctgttcccatccattgtggatgtggtgtaagggtctaaagataaaggttccaatgtcagggaacctcaggtcttagtcttatgattttcatgctcccaccccagccaggttgtgggctgtgaactgtccccaccagggcctctgctagcctgcatggtgcctttgtgcaaattagaaaatggcaccctctctgggaagatgcagttgcccccctcaccacccccccaccacttgaccagtggaatttctagccttgatgtgatggagagtggccaactgagggcagtggcactggtttgccttcttccacaggtccctctcctccaggtgcccttccagcctcacctttgcagtgtttgccgtcccctgtgtagccagacttgcagatgcacttgtatgacctcggggtgttctggcagatagcatcgatgtggcagttgtcagtcccctccacacactcatccacatctggcaggggcagagggggcacatgagaacctctgttggcacctcttaaggggtgtcttgaaggtgggcttccaagggcagaatcccctcttctctaaaacagaggcagtgaccccctccagaaacaggtgctgtctcacatctctctgatttcagagtaggcagacactgattttgggaattcagaaggaacccccactgccctcaaaaatactaaattcacagtgacagctaaaactccatcattcgaaacactcctttttttatttgaaaacaaacaaaaaacccttagagtgggtagtacacttaacttgattaggaataatcaacttaaagtgaatgagtttacggagaaggcttagagggaaagttaagggaaaaggcatgggaacagtggtctctgggaaggtggcagggtccagcaatcactagtaaaggaggaagaaagggggatggggcatctgagggatcttcatctgtgtcatgattctgcttgagaccaggcctgcttccacttgcccaccatggagccaagaagctttagaggaaaaatgttccatcctggatgattttcctcggcccctgtgctgccaacaatggagacatccagagctggcagaggttggcaccagctacctgaagcctaataagtgcagcccttcaggccctaatccccagtgtttagccctctgtctcctggccctagctctaacaataggtgctacacacacagctatacttgaaggaagaggccactcaccatctagcaaaaaagaggatggttaggaaaggacatagatgatgccaggcgcggtggctcatgcctgtaatcccagcactttgggaggccaaggcaggtggatcatgaggtcaggagttcgagaccagcctgaccttgatgaaaccccatctctactaaaaatacaaaaattagccaggtgtggtgatgtgtgcctgtaatcccagctactcaggaggctgtggcaggagaatcgcttgaaccagggaggcggaggttgcagtgagctgagatcgcgctaatgcactccagcctgggcgacagtgagactctatctcaaaaaaaaaaaaaaaaaaaaaaggacatagaaaagagtccaacttctgaggcaatattatggtgcccttaaatctgaactgaaatagagaaacatgttattcagttgaaaacgccttattgagtgtgtttgtgaaagacactataatgatagctgtggaggctcaaaggtgactcagcccagccaaaaggagaaacaaaaaacatggagcagaatgtggtacatgccctgaagacatgagagataaggtgagggggtcctccaccctgcacatcagagtcaactctcctaggagatgtccaagccacaaccccagagattctggtcagatagcctggactggtgccgggccatcagtatttttctaaagctcttccagttattctaatgtgtagtcaaggttgagaacctgtgttacggggcagatcagaggagaaagagattacttccagctggaaactgggaaacccaaaatagtgtcttaagtagcagcctgcaagtgagtgatcactgaatgggaggcattactctcctgtgatcccacaactgagcacagaaaggagatgagatttgacaccaagacaatttgatatccaagtgtgatctatgggccatagaattgcctaggttttattaaaatgcagattctcaggactcattatagcctttttgaatccaaatccttaagtgattatttttactgagtgaatggatgcatggaccagtattctctccaatttatagatacccagagtcctagcttgagacagttatctgtcctccgcttttatactctgaaacttcctggggctaagaagagaactgaaatccccaaacaccctgcctcaaatctcacaggtttccgttcagctcttcattctacccttcaactcctatgcagccaaccatcataccagttgattctaagtgctgggagcctctgtctacacttactctccacctcgctcaggctccataggcatggtgtctacctgctggcccatcctgggaagtcatcccaacgtgacagaatggaaaagagagggcatggaagactagttcataggtaagggcaagagggacctcgcagatggtaaggtgctctgtggagaatcagtttgtccaactgataaacagaaaacagtacaaagaaatgtgctatcacagaacgatcttaagcactggaaccagtcagtcccagattcaaatccagctctacccttctctagggatggttttcttattctccatctcctcccccttaaaatggggatgataatacctcctcatgagaggctgtgagtagctgatgggataatttgtgtaaattggctaataaagtatctggtaaacagtagggtcccaatacaggaagcttgagatggtattaaatcactggtcaggcaatagatgctcgagacagtatgacagccactagccacatgtggttatttaatttaaaattcacttcctcagttgcactagccacaggccaaatgcgcaatagccacatgtggctagtggctaccatggcggaaagcatagatatggaacatttccaacaccacagaaatagcactgctattagcacaccacaggatagcactgctctggggttctgaataagagatactccctgggtccagcagcacggatactggtctggaactgctcccctgaccatatcagaggtatgtgcctgtgactgaatcagctggtgcttcactagagactgtgtcagactatatgggctcccaattctttcctttgcctcccattcagtgctcaccagtactagagtggatcttgatgctgatcaccacaaacccaggcctcccagcagattcttttttttttttttttttttttttttgagatgaagtctcggtctgtcacccaggctggagtacagtagtggtgtgatctcggctcactgcaacctctgcctcccaggttcaagctattcttctgcctcagcctcctgagtatctgggattacaggcatgtgccaccacacttggctaatttttgtattattaatagagacatggttttgccacattggccaggctggtctcgaactcctgacctcaagtgatctgcccgccttagcctcccaaagtgctgggattacaggcgcgagccactacacctggccacagattttttagacccctcctacagccagacttctcccaccatctaactaacccctctcccttacctccctgctcacaatgcttatccctctccagcaaagagtctctgctctggaagacattatctcttcctgttccctctacaatacctaaccatcctattcctttctatgcatttgcgtattttcgttattcacattgcagatgcattcctcatttttctcttccagccacactatgctcagctttccattccagctcaaatttttcttcccaaaagctcttccttgtaagccccgttcctggtgagttcctggtccaaggggactgttctcctcagttcatttacagccgtcactgaattgctctgctaatactttaaagcgtgttcagctttcctcacctggctgggtacctgctgaggaagatgtcccttcaatgtttggttggagtcttttgaagcagaacagacctaagacaaagctgtgaaagagggccccaaattatacccagtatctcctccttttaccactcattcttccagagttctctcctaccatatgtgcccacccagaatttgtccttgcaaggacccttcaacgctcacagcacagtctcatcttagcctgttctctcaggatgcaggtgcttactagctggaaaaccagttgatgctactgggtgtggactggtttaaaccagcggttctcaaccctggggctacacactggaattccctgggggttttgaaaaaaatgtgaatgtacagatgtcccctagaccagctgaatcaggatctccagggtgaggctgtggctactatctgtcttcctttcccaaggtaatgccaataaactatttgcccaagctgggaagagaccagggcagccacatgacagagtagttaagagagaggttctggagcaacattgtcagttcaattgctagctctacctgtgtctgtgtggtcctgggccagcctctgaacttacctgttccctcctctgtatgtgggaataatattcatcatagtacctccccatggggcttccaggaacatcagttgaattaatacccatcaagtacttaacaccacagtgtgggcatatagaaagtgctcaacaaaggtttgctatttttttctttctttttgaaacagagacagggtcttgctctgcttatccaggcaggaatgcaatggcatgaacatagctcactgcaacctcgaaatcctgggctcaagtgatcctcccacctcagcctactgagtaactgggactatatgcgcgtggcatcatgctcagccaattttttaaaatttttagaggcagggtcttgctatgttgcccaagctggtctcgaactcctggatttgaacgaccctctcatgtcagcctcccaaagtgctggtattacaggtgtgagtcgccatgcctagccaaggtttgctactattattccttctctccaaccttctccctgtattctttctgaactccctttccctatcaaagccccatttcaggcctggtgtggggaaatgcagcaccaggtgagcatgtgttggtggggaggatttggggagacacatccccactgcttactctacctgtgctgggaactgcacaaagaatgggggtgaagtgggtgagaggccagttgggaacccaaaagctgtcctctacaattctttttgaaggctagggagatcccactcctacttcaggccatgcattggaaccaaagttgaggtgggggagagtggtggctgcacagataccatagacaagccaagacctccctgcctcgccctgtcctggcatgaaggcacaggtctgtaactacagcagcttttcccagtaccatctgacatttcttctgaatttgctttagcgcctagcagagcactccataaactctcctaaagtaggtaggaagggtaggatggggtatgggatatgagggtcagagggtcagaccagaaagggtggattattataaaacaagtagtcctaagattctgaggatgggcaggtgtaccctaaaagggaagcagtgggattcccaagtaaatacttcatctacttcacaagtttgcccaagcccagctcaggaacagtaacaaatggaaatgagcagggatgccggctgtggacaagcagaccccctaggtagagtccaccccaccttcccattaccacaggaattattaccttaccacccataggggagggggtaattgtgggcaaatttgatgggcccagtgggacagtcagaaacagcctgcctagagccctaatgtacccacccacatagctgtgacatcctcagcccagccaggctagcccaggatatatggtgtgtgtagcgcactctgctattttcctctccttgaatgtccttgaggacccagttcaggtgcctctgctgggacactccctgtgacactaccagccttctctgatctactctttctcttgactcctaagacttactgtcaggctctctggtcacctgatcaatcccaggcttgtgatacctcatatgctaccttgtaccattatttaacttttagttcatgtgtataattttcctactgaagcagtaggagcttgaggccatggctcctaaagctttgaaacccatgcagcaactgaaatagagctcagcattcattcattcactcactcactcaatagttattgagcacctccaacatgcgaagcaccgtgctaggtgctggggatttggcagtgaaccagagatgaattctacattgaagccacttagtaaatatttgttaaacagatagacgagtggatggagacatggatgcattagtagtgagtggataatgtctctatctgtggcatcccttctgctctatgttacctcagagaaaaatctcacttctttactctccgtgatcccacaactgttctggatgggggaagtcccaggaagtttagtctcaagtggagagtagggagagaggaaactaaattcagaggggtagtacccacttaaaggcatccatatgatgagtgctggggccagaagagactggaaccaatgagtcatagggtctcagggtcttcagacatcatatggggctgctacagggatcttttcagagcatccccttcaacagatgttcctcagcctccatgctaactctcaatgatggggcacctgacacaggcattccactgcttgcccctggtgatttccctcattctcacctctaagtaacatccaaaataaaaccagcccagccttgggccatgatatcctaacccacagcatgtgcacatgtacccacatctgcatatctgctctacctccagatcaaaatagcaaccagggagattggcagagcctggagtaccaggctgtcttcccagtttgggactggctgaggcactgtgacttcagtgagagtctgggcccatcctcagtctagaaaaagcttatgcaaggatgagggtagcctagagaaagtccagaaaaccacacaaatgaccacctgttgattccaaggcggagacagagcactttctccttttaaaaacagtatcctctcctctcactcaagcttagcctgctcaactgaacagccaggaaaagctgctggtgtttggtgatttgaagggaagggggtctgaacctcagaagcttgtcacttactggggaccctgatgagtttctctctgttgtcctgccttatccctaatctagctccctgatcatttgaatgtaaccctaattggacaagaattttctccctttcagtatggacaaaatcaacaaccatgaatcagagacttttagaggatgggtagtgaagtgggggaagaacagaacattgtagagtgaggggcagagaggcaggcagtgggcatgggtaggttctggttttgtgattagtaatattatctctttaattgaaaaaaataaactcatttcagattcgtataatttcactaagtgtacagttttttcatgcaggttggttcacgtggtcttcaaactgtcctctctcatctggggcccagtgaggatacctcaggaaagagcaagtagctagtgtaaagccaggatccaggtcttcaaactcccagtccagtgctctctaactacccactgtgttctctaagcacttgagggaggaatccatgccttagtcattattgtacctcccccaactccacctcagcacttagttcagcatgaagcatgcatccagtatataaccgtggagcggaaggagctgaaatgtacatgatccagggaggaaatcagcagtgggaatgcagatgctctgaggctttgggcatgggagcagcagaagagagcaaggctgagtagtgggcagggagggtacagacacagttgcaataaggaaagggtgggcaatgcaacagtgggcaggtgttgcctgcccttggattcactatgctggggccaagcagctggttagaaacaaaaacaaacaccagggatacaggttcctgctgttaacagcttcaaaccgccagaggaaaactccaaataaatataattagaaacttgtaaaaacgtcctctctgtaaacctgctccccagggtctacccttcaagcactccccttccccagccctccccccaatgcccacatatcctgatactccccactttcagagggattccttagatgtgtttccttatcctggatcttccctccagccctgcagcccctgcccaggtctttcctcagcttgttaccaccagtgaccagacctgaagagcccctggtgtaggctcagaaatccaaaccccacagctctctagggctatggttataaccacagggaaaaccagaggtaagagcaaggaccactgtgccctatataggggtcatcatcccatttgttcagccaaagcacagcatctaacagcaactacaaagcagtgcttgatctgcagggggacatgtctaggctagggcagaatacagacagctagtctcagagctagaaacacggaatcctggggcccagatccaagaatattcagttcccataacacggatatttcagctccacttcccaactttgttggatacacacatatagaaacacacatgtgttcttcaggggctatttccagggataaatacccacttcatggacacagtaagaactatcagctacttggggttccaggaaactggggtgggggaagaaaggaagagtatccagatgacctagcctcaggcaggcagaagtggaccagcatccaaggaggagagcgcctgagatttgggtgagtaacctgtggaggcccggcgccttctgccttcagcaggaaggatttcagtgagatgtgcagaatctcagggctgcagggaaccctactgatattttacaagtgagaagagggatttcagtgatttcctccgaggctcaaatccttaggctctgcatttgtctaaacccactggcaccatatacctctatatccccggtgccacttgaggctggcattgggtgggcataggaacaggagagtagccagtccaatgttaagtggccagtgggggaggggagtctctgtcccctcttagcccaggtgactagctcctgtaccccctagacatccctgggttggccgttgtttcgcttctatacccaaggcccagcagtccttctgtttccagactccagtcttctgagcctgaagaagctgtccccaggtctgggcctcttgcaggcactgccagcctcagagcagctctgcagtttccagccctgacagggactctttcttataagtggtcatgtgctagggatacgggatgtcaaaggaggcccacaccctgacatttggggaccagagctgggggaaaggactgagtgagttcaggcagcaagctcttccagctccatcttctcaaaaggtctgaagcccttcgttcccttcccctgtcctcagttcaaggcactggaccaagccattccacttctttacttctccaactaaaacaaaatgcatattgccccacttcctttttcctctcaccagagcacttcacacacacacacaccctgagtcatgcacacacattcacacgtgtgtgaatgcacacttcacattcccaaactcacacccagggccggctcctcttacaacaggtcccagctgctcacatctcaaaccggttctcatgctctcagattcctgaaggtttcaaaaaacaatctcatttgagggctgctgatgactgtcttctttctctgcctgcagtaattctggccttagtgtcttctagtcccctttctcttattccaccctgcagagactcaaagagatgagaaggaaggggttgaaaacagggaaaagtctctgtactctcccaccccgaggctttccccacctctgagacatgtcatgagagaagagaggtcaaagggattcctgaggaatttctaagcagtccaccctcttctccaccttctggaaaaatgggggtgggcttagagggaactgactaaagatcaggctctgagtggggactctccctctctccagtgtggcctggacagggcacaggcaatagccggctgcccacggggccacccttacccgctgacatggttatggttttcatttcatattttggagggaggggctagtaggaacagtcccctcactgtaagagctggccacaggagcccagggaagcggggaggaaaggaaacagccacattaaagaggaagagaagggtgggagaaagaaagagacacatacacccagacagagacccggagagacacaccgagacagagagacactgtttgccaccacatgaacgctctcagtcccagggatggggttacttggaaattctaaatgcatgactttatcaaaactctatccctaacaaggagagaaaactaccaggtaaactaaacggccaggctggctctcctggagccagccctggggacaagtttccctggaggccgagagaccttttcattcagctgtaacctgagccctatgcgaggattaggtctttttaaccactgctgcacacacccccccccccgccgcgcctcccccccgccccccccccccccgccaaacacccacccccttaccaaaagcaaagcaaattaatgcttttaagttaacaattatcttggttatccagtctgtctactttaaaatatacagacaagcacttgaaaaacactcaaaaccatgtcccctcatgctccctcccttcccagtcacacaggcttacccacctactcttccatacagttctcacagacactaaaacagcagtttacccttagcaactacgtcacaagaaacacagacatccagctatgttgcctgtgggtaactgtggtgaacctctcatgtgtgcacagtcgcacactcacctttacacttagggctcccttccttgtctccccctttccccccttccacatgactttggttttcccattgtgggaatcactgatgaaaagggacagaaacccagatacccccagaggtatagtaactccgtgcaagatacttgccaagggtatttgattttaaagacctgctagtgctttatataaagcatgtggcattaaaggcacactttctggcactgctgataaccaggagatatgtttgaaggtaaggcctccctgatgctcacagactgtgtctatgggtaaggctgtaaggttgccccgcctggtcagtactagttcttcctgcagcatctgcctgcaagtttgtgtccagagacatccctgtaacccagcaaacctgctattaggcaacctctggcagatggggtttgtagatttcctgaagagaagggtcaatgaaaggcttccattctaggccaagcttagggatcagaagaaaagaaggaggataccaagctaactgcggtccagtcacaggaagggtggcctgtgaatgagataagctggggacaaaaactactctaagttccttgagggcaggggccttcactctggcagcatgttcctcagtacccagcagggagtccaatgaaagtggaagccctggagtaccatgcagggattctgactcccgttcctgaatcatgagctgatctcccatacttgagtgccttggcttgatggcacctgtcccttggaggggtctccatctgcccctgggcccccctcgaatacactgcttctcctttggtccacagcctcactaggccactacagacactggctccaacttgaaagaggcccttatcttgtctctaggttacttcatgatatctgttccttccttcagactaaactccccacctaattccatgttatgagtaagtcagcacacactacaaaagccagctttgtttatgaaaacacaaatccacagtgaggagaggggctgctcccaggttgggggtggcagtggcgatgcgctgtctggaaccaggactggaaaagaggcagtgtggggctggaaggtgtgggggcagggtccagtatttgacagctgaggatctctagtgtttcagttctgtgaaaggacaggttggagggggaagaggttagctgaagaggcagtgtttggggagaggagggcggcattgatacagcaccttcctcttcacagagcaggagcccatccaatacaacagagcagcttaagagccaaacgctcaggctctgggacacagcgacctgtgtcggacactcaggcttccccaactcccaagttcaactttccttctggcccagccatctcctcacccagctggcttcaggagcccctgggacaataggcagaatcatactctcctgggcaaaaccttgccaggaggaattttctttttgtccatataaatctcttgtcggtgaggacacgatgggggaggggtacagcaagaggtcaagggggaggagaaactgtcccgagagaactgtagtacatcagcctagtctctgcctgcacagccttgggacctgccaggcgatgagctgggggtcagggacgggggcgggaggcctccctgtctctctttaattcctagagggatctgtcagagctccccggcctggaattctactttgttattttaatgcaattctgacctggatttaaatggaattggaaacccgaggccttaataaataaatattatgataagaaatgaaagccatgcaagacgaaagagatttcaccccaaagaggcagaaacgcaacattcctgtcgggagccagtcacagaaattttcttctcttcttcagccccctaccatccggtgagagatgagttgatttttccataaaagatcctatttttcttcaacatttttccactgataaggcatcaacttagaaatgtctaactttgcatgcgggttgggggtaagggaaagaaatatacggcacggctgaaaagttttcattattccctcagtctctccaggccacagcgtaagtttctggcaatgtttgagagaagagaaaattctctctcagattttggaagacaagaagtctttcgaagatgctgggagtggatgaagtcgagcggaattctgaggcgcgtggtctcttctgcccaccgcccccaagagtttctcactcctctctgccgcccccagcttgtccggcttttcgctcggggcgcagcgcccagcggtcgggcccctggccggggagtccgggtgcacagagccgggttctgacagcagcacgctccccagcacctgccctgcccctcgggaatcgctcctaggccctgaggcccagcagccaggacagcccccaggccgcgcgcccctccttccttaccttgcgcggctttgctgtactgggcggcgcgggcgtggaccagcaggacaagcaggcagagcccgggtacgcgccccgagcccatggctggagctactggcggcccagccgccggggccggtctcgcggccaggggagggcggaagccggccggatcccagctcgcaggagggggaggggagggggcgccccgccggggccaggccgggggctgcagtcgcggggcgcggaccgcggcgccctcggcgcgaggctcccgatgctaccggctcctcctggccggacgtcggggagagcgaggcggagagtgcgacgaggcgaggggcgccaggggcgactgacggaggggaacccccgccctctccaagccggcctctgccagcggcggcggcggggctgctccgtgtaatcccacccaattcccagcttcgccgggagagagctgcagccggagagcgcgcagagcccgagcgaaggacctgagaaaggggaggggaaacgcagcgccagaaacacgccctttctgcctctctttcttcctctctcgctctttctccgtctctcaggctctttttcttcgcctttctcctcctcctcctctttctcctcctctcctcgctccttttcgttttcttcctcctccccctcctcctcctcctcctcctcctccttctccaccacctcctttttcgtgcccttttttctttcaaatggggcctcggcgcggtggccgctccccctgcgcgcccgggcgcggtggccccctccccaggctgccgggccgctgcctgcaggaatttacaatccggcgatgggggagcgggcctggtctccatggagacggcttccccgggagcagggaggtcaggcgcagaccgcgcgcaatcaatggatcaatgcaagctccgctcggctccagaccaaacagcaccgggctccgactcgtcctcgctcccctaggaaagagtcggggagcgagggtgcgtccccgcgctcgctcgcgaggacggccgtgcggcgccaggtttgaacgcacacctccacccgagacaaagagggtgcgaggtgttggggaggctggggcagacgtggacacacggacacacgggcactcgggcgtgtccaccgacacagcctgacaggggacataggacctcggaacacaccgcctccgacaccaggccgagtaacaacctctcaacttttacacctaccacacccccaacctcaagactcagtccccattcctagatgcgagtccactttgaggaccaaaaagaaagtagcctccgcctgctaaaactgccagctccagggcagactcccttgcagttaaggccttggaggtaagcctaatgaaccaccctacccgcagagacatggactcacatacagacactctcatgtggtcagcacaggggcgaaagctaccccacagaatcatgtctatgtgtataaacacagagacatagagacaggtacaagaggctcctccaaacctgcaccccgcttcaagaggtggtcctgactggtccattctgaacccttcatccttccaactgaggggaagcagaggaaagagaaaggatatttttaaaacaggggcaaaccgcagaaggagcagggtcttccaaccatggatgctgcctcttgactgttcacccactctgtatcttctttccttccattgtaagggaaagaggaaagacctcttgaaaggctatgaagactttcttggagtgtgaggctgtgttcagaatgagaccaggccaggtccagttttctacagggaagatgctgctaggacccagactagcctcacagagccctcagcgtacccaggaggaagaggcaatgaccaagatctcctcaaaggtgccgccatctaacataccatccttcagcccttggtgaagtcctgaagccagacctctgggagtctactcagggaacccactgcctcaaacaaatttgcaaataaaattattgtatttgaaataggcccacattggtgaagttaagatgtggaactaattgtatgtgtatttctatataaccacagactcaatgtttgatgtttgacatttattgtgcacttactatgtaccagggacttaaaggatgtggggattcaaagatgacatggtttctccttttaagtttatgatttggcaagagaaattcacatctaaataattggaatataaggcagaatgtggtaaatgtccaaacatggaggtgccaacataaaattctaatgagggcataaagagcacagattaattccagctggaagcaggaggacaactcagtggaggaggaaagggtttaaagctgacctcaaagaatatatagaattctcatacatggagttgggtgaagagagtgagggctttccaggtggcaggaacaacatgagcaaagacttggagaggagaatgtcttcagggaattaataattggttcaatcagagacaagtatttcagagagtgtggaggaagatctgaaaggtgggatggggctagacaatgaagagcctgtttccatcagatgctaagcgactgacagtgttgcataggctccgggaacccggcaactttacagcaaagtagcagcatggcgggctcacttcatgaattagctttatgtgtgctccaggatttcttcaatgtgttgatttttagtgaatttatttcatcatgaatgcaggaagagaacagaaagaaaaacggggaaaagaggacataaaaagaagtgggctgggcatggtggctcacacctgtaatcccagcactctgggagcctgaggcaggcggatgacgaggtcaggagatcaagaccatcctgactaacacagtgaaaccccatctctactaaaaatacaaaaaattagctgggtgtggtggcggatgcctggagtcccagctactcgggaggctgaggcaggagaatggtgtgaaccccaggaggcggagcttgcagtgagccgagatttggccactgtactccagcctgggtgacagagcaagactccgtttcaaacaaacaaacaaacaaaaaagaagtgacagggagggaaataatggacagaaggaaaagagagatggagaaggaagagagagaaagagaaggaggcagccctggaggagacaaggcaaaccctgaactgttcaggggccaagcttaaggagctacttgggcttttccaggcaaacgacctctggcttcttgccctggccaaccacagaggacaatgtgaggcgagtttgtttggtgatgtgttttctgctggccctgtttgtttgtttttcatttttctggtattggacagatctggggtgaaggaagagggagacagggttgtggctggcattgatagtggtccttgggctgggctctgggctgcccagagcccccctttagtgggggcttatgggcattggagctgaacttttgatgtccctggaagggggcctttttgtaggtgcccagagccaggtggccttcccaagcctggagatggtttgccctaagctctttgtctctgtctttccccaccctggcaagaaagaattagtccttgaggcctgggctccttgcctgtgtagccaggatgtcgtgctgggctggggagcccatgggggtagcaagagcagctgcttccagattggtgctggggaacgcaggggcagtccacgagagccagccttctccccagccccgatgatgagtctggctttctctcccgtcccacagcccttggaagccaacctaacaagttctattaaagttaatgaaacacaatgattcctctgtttgcttggttacaactcattacgagttgctcttgcttgctcggcttttgcagaggagattcatttgagtagccagtgcttggcctttgtccccctaatttttactggcccattaacaagatcagacactttggctgaccaggaatatctagtacccaagtcccaacaaaacccattgggtggagtttcagatgaccttttgagtctaaattagcctaaaaacatgctgccgcccttcctccctctgttgcttccctatatccaaactcagttttatatgtaggtacaataggagtatgcagagatttcagaagttaggagatgcttttccagcctctttagaatgtatctcaacccactgatttagagaagttccctagtaagagctccagctcgatttaagggctttcctcccccatttaaatggaaataaactgaacattgttagtcacttatactttggtgtgaattagttcatattgtcactttaaggggatttgggagtctcctaaattgtatacaaacttttgtccacattatccattcttccagagagaggttttctatagctttcttcaaaatttccataaccgtccccccaccccctaccccaacacgtacacacacacacacacaaactctctctctctcaaaaggttaacaacctctgtgttagtagaagagtgggccgtaactggggcacagaagacaaactctccttccttcaccatctgcttggccagtcctgcctctaaggagggaccttcccctcctccttgagttccttatccacagacctcccattgtcaccacagctcaatcatgtgcttcccaaatcttaaaaccaacctcaagttggtggggaggagtcaaaaggagagcccttgaactctatgttgatttacatgccgaggctgtaaatgataggtttacatgctggtgtaaatactcataaactcgcagtaagtgcagggcatcacatgctttcagtgtccagatcctctgcagcccgtacaggcctggcattctcagggtcagggaggagagcgccgagttggcagcagctagcatgacaggggctgactatgactatggaggaaaagggcgtgcttggagttggtctctaaaccctcatcctctcccatacagcaggtggcttctgcacagtgataccttggcatgactccccctgctgctcagccagcctgactgttcttttgggttaaagcattgtctccagaaggtccctgttaaaatgcaaaggggcttcttgcagggtgacttgggctggttggctgactggctgtcactcaacagaaaacagagaccccagatcagggaggttaaggtttgggagaaaggttcaggtgggtcaatactatagctatatgaagttgatttaaatggctttccaggtgttctccctaattccactcttgggggctgagaatctatccttcatatggcagccagagtcgttttaaagctgggccatacaacctcaacgtgattgacgtttgttggggggccatcctatgcattgtagcacatttagcagcatccctggcctctacccactaggtgccagcagcagcactccctccccacgttgcgacagccaaaaatgtctacagacattgacacatgtcccctgggggaggggagtgaaatcataccccctatcttcacttccccctgccccactgagaatctccatcataaagtgtaagtcagcccatgttactccctggtcaaaaatcctaccatgtcttctcattgttctgagcatgaaatccgccgtttggcccagccttcaaggccttgtgtagtccagccttgcctccctctcctgccccaccttgtacccctctgctgtcatctaccatcaccctttagccacatataaccctttttgacatacctcgataaaccaagctctttcttggacagggtggaagatggagagatatgggcagatttagagtaagtttcagaggccctaatttctttggattttactgggaggccttttcttttcgcttttttgagatggagtttaactcttgtcgcccaggctggagtacaatggcgtgatctcggctcactgcaacctctgcctcctggtttcaagcaattctcctgattcagcctcctgagtagctgggattacaagcgcttgccaccatgcccggctaatttttgtattttttagtagagacagggtttcaccatgttggccgggctggtcttgaactcctgatctcagaacgtaagctccatcagagcagggaccatgtctggcttgttcactatcgtgtcctcatcatctcctgtactgcctgccacatgaacaatggccattaacaggcatggaactggagcagaaatggaatgaaccctaggggcctgggagcctggaggggtgtaggagtggggaggggattggggagacaggcggcagaggaaagcgcctgccctcgcctcctcccatcaccccctatacccctgtccctaatgaggtgcttctggcggcacctgacttttccattgcaaacaccacttgactctcggcccttcacactctcatgaggttctaaggggctgcacaggcgccgcccaccccagccatgccctgggactcaccacacaccaggaaggccgggagctgcagcaaggggacagcttaaaacagccccaccaacaccccaaagtgggtctcccagttccccgagaaggcctggatgccctgctgaagggtgagcagggccatgtgggtgacttggaggacccaattccccggccatgggaacccccagcctgggctttctttgggggtagctgagacaacgagcccccacccagagcaggagatgacgcattttttctgtggccacaagccactttgacgggtccgccccactggggagcaaccgaaacctcatcccacccaaagcggcctttgtctgcactacatatttgtcttatttggaagatttttgtgggttttcctgtctttctccagcgctcactgccctaagggggacgaaggccatggcggagctgagggaagggggtgagaggcattcttggggcgctgtgcctggtggtctgcagcacatttgggggtgggagagaaatccaccccacacaccctcggcgccccagtgatgccttggccccaggccacactctgggccttgcctgtcctctgtggactcgtgcccctcctggtcctcccagagctgtttcctctccatcttctctcagcctcctcagctcactctccaatacttctgtttattccctcatgttccatccttccagccagcttggcacctcatcatttcctacctcccccgtcatgggaccctctgctttctttctacctgtctgaattctgaagactctcccagggcttgttcccccatcttgcctcctcctgggagcctccctggactactgtagcgcttggcaggatctcctccttctgaaatgtaaaagtatgtgttttctatcctttctgtgattctaaacacaccctgcccctataccacctgcccagctaaatagaggccagaggccatggcttttgtgccttggcgtccaagccccatcctgccttgtacaaagcaattgctcaactaatatttgttggtttggggcttcttaagggctacccatgagattaccaacaaattagagaatttcagtgatggaagggacctaagagcttgaattcttgctaaggggtgtctgggttcagcttacatacctttaatgacagggatcttaccacttcctggggcaacccattcccttgcctgtaactctgaccataagaaagttcttccccacgttgagctaaaacctgctgccttctggctttccccaccctactcccaactaggtcacatcaaactattccagtcctctttcctcacgaccacccttcagatatttgagggcagcaatctcctacctctgcagtcttttcttttccagggggaaacacctgtagtcctaaccttcagtgccccaatgcccctgatgaccatggactttgggtattcccccccacccctgtgctgggcctctcccacatccctgctgaactcattcttctcacaaaatcccc

SEQ ID NO: 641 - DNA, 1646 bp, Homo sapiens
gatatattctcggtgaaggagttagcaactgcaatttgcgctcaaacctggctgttccattaacttttataatgaacctgaaaactgagtgctggagtattattaaagctgctattttacaggtggtgggagagaggatcttgaagttgtcttcctctttctggcttatttcacttaacataacatcctccaagttcatccatattgctccaaattacagaatttccatatttttaaagaaagaatagtatttcattgtgtatatttaccacaattttctttattctttcttctattgatggatacaggttgattccatacctcggctattgtgaataatgcagcaatgactatgagagggcagatatctcttctacatattgatggcacttcttttggatttatacccagtagtgggattgagggatcatatggtagttctatttttaattttttgaagaacatccacactgttttctgtactattgccaccaacagtatgcaaagattcagattttctccccattctctctgatacttatcctgcatcttattgttagtagccattctaacgggtgtgtgcttagattccactctggttgtaatttgcatttgtctgtcgattcaggattgtatgtggtttcattttagattttagattttttttctatttttgggaagaatgtcattgatattttcatagaaattgcactgaatcgctacatcactgtgggtaatactgatattttaacaataacaatcttttttattgttcttttagtctcaaattcatctatttatttcctaatctttattttgttccttctagtaatttggagtttggtttattcttgcttttctagttatttgaagtgcatcattgggttatttatttaaaatatttctatttttttgatggaggagctcattactacacattcctctctttctacagctttgctgtataccatagattttagtatgttgtgtttctactttcatttgttttaagaaaattttaaatttttttcttaattttttcatttactcattgatgtttcaagagcatgttgtttaatttccatgtgtttttatattttctgaagttccaccggttacttatttctagttttattccattgttgtcagaaaagatacttgatataattgcaaattttttaatttgttgaaatttgttttatagcctaacttattgtctatcctgtagagtgttctatatgctgatgagaagaatgtatattctgcagcaattggatgaaatgttctataaatgtcagttaggctcatgtggtccagggcatggtttaatttcaatatttcttcattgatgtgtacattattgagagtggagtgctgatgtcctctactattattattttgaagtttatctgtccattagatctattaatgtttgctttatatattttgtgctctggtgttatgtgcacatctatttaaaattgttatatcctcctgctaaattagtccctttatttcaatattgtgactttctttgtctctttttgcagtctttgaattgaagtctatttcatctaatataagtacctataatcctgattttttttgttttacattagcatggaatatctattttccatcatatc

SEQ ID NO: 642 - DNA, 10528 bp, Homo sapiens
acacgtagcggccaagatggcgctagcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggccctccctccgctgtctccctgaccttcctatgcatccagttgcttaagaactcttggaaagatagtaagtgaaatcttcatagaggatttttgtactttaacatatattatttgatttgagcctcgcaacatttcagtgtgacaggtacgattaaggtctttcatactatgaatgagaaaaacatagatgtaccaaggactcaccaaatttcacggagctaggaattggaagagagctaggctttgtaatcccaggtcttctgacctccaaatgtcctttcctctacagtgaatgtcaaaatgacaatgaatgtctactcctctacaatggagtacaaatcgaaagacaaggggcttataaaactgactctgaccttaagaagtagcatatgagtgatgaattattatagtcaatccttgtgcttactaagtgccacatactggtctaagcattttacatagtaattcagtccttagaacaactttatgaggtggaaacttttattatctctaattacaaaggaggcaactaaagtctaggaaagaagcaaaatagcttgcctaaagtcacacataagtaaatggtggctcacgcctgtaaacccagcactttgggaggctgaggcaagtggatcatttgaggtcaggagttcaagaccagcctggccaacatggtgaaagcccacctctactaaaaatacaaaaattagctgggcatggtggcatgtgcctgtaatcccagctactcgggaggctgagacaggagaattgcttgaaccagggaggtggaggttgcagtgagccaagatcgctctactgcattccagcgtgggcaacagagcaagactccatcttaaaaaaaaaaaaaaaaaaaaaagctaaagctgggatttaaacctgattatgttggctccagagcctatgctctagaccagtggttctaaactttaatggtcaataggaaccgcttgaggatcttgttaaaacgcaaatattggtagtatagatatcaggtaaggcctggatcctatagtcttaacaggcccccaggtgatgttgatggtgctggtcattacatactacagttcacatcttcccttttctcctaaccgtatttattttgcagtcagaaactacctttcccatgctgcctgtgactgctttatagtctcaaatgttcccaacatgctcttccttaaggattagactcaaactttttcctcaaaaagcttatcctgcccctgtctttccctctaggataagacagacatccctgcctctgctcccctaccactcagtgtacaccttgttacagagctcagaacactgaattatggccatttatttgaaaatcttcctggccgggcatggtggctcatgcctgtattcccagtactttgggaggccgaggtgggctgatcacttgaggtcaggagttcaagaccagcttggccaacatggtgaaatcccgtctatactaaagatagaaaaattagccggtcatggtgttgtgcatctgtagtcctaggtactctactcgagaggctgaggcaggagaatctcttgaacccaggaggtggaggttgcagtgagctgagattgcgcaactgcacttcagcctgggcgacagagcaagactctgtctcaaaaaaaaagaaaagaaaatcttcctgactggacaacgagctctttgaggagaggaaccaatcaggtctgtgtactgtagagcctagcatataataagaataatagctaatacttacataggactttctgtattccagatcacgttatacacattaacttgtttaatctctactataaccttacagatacacttttatccccattttatgaatgaagaaactaaggcatagagaggttaaatagctggcccaaggtaacaagcttgtaagtaacagagccatgattttaaataaaagcactttggctccaggaaatgtgtggtgaattaaatgagagccactctacactcaaccaaagaaggaaaactgagacttactatcctattagacatgattataactacctctagtctgggaaaatacacagaaatctgttcccctggccaggtgcggtggctcacgcctgtaatcccaacactttgggaggccgaggcaggcggatcatctgagatcgagagttcgagaccagcttgaccaacatggagaaaccccgtctctactaaaagtacaaaattagccaggcatggtggcacatgcccgtaatcccagctactcgggaggctgaggcaggagagtagcttgagcccaggaggcggaggttgtggtgagccgagatcgcgccattgcacagcctgggcaacgagcgaaactccatctcaaaaaaataaataaaaatttttttaaaaaagaaatctgttcccctttgctggatttactttttttcctttctgtcctggaccccatggttatttatttcaaattcagtctcaatcagtactttcaagtttattcaaccatctctgtccttccatcgaccccgaaatagtcctcaacctgtgatcagtttcccatctttcctcatgtttgatatagctgttagttaactcttagtgcataagaaaaattatcccaaactttagtgacttaaaacaagaataattttttaaatttttatacagtttttgcattttctattggaatcaagagtggcttagctgggtggttctggcttggggtctcccaagcagttgcagctatctgaaggctgactggggctggaggatcagcttccaaggtacctcactcacattggttggaaagtcagcaaggaaagaggcctcaatttctcactatgtagacctccctataaggctgcttgagcatctttgggatatagtaactggattgccccagagcaagtgatccaagagtgttacagaagctataatgttgcaatatgtatacagagagatttagatataaaatcagattttatatatgtttgtataaatgtatataaaactcacgtactctgaaggtgaatttgtacaaagcagtaaagctagaacaactggtgggaataagttgaaataatactgcgtagcgtttattacagacccattatgaaaagaacaccttgcttatcttatttaaaccttacaacattcctatgacttggtaattattgttccattttacagttgaggaaaccaagccctagagaaaactcatttgtccaaattcaaatatcaccagaagactcttcccccaaacacacaggtgttaaggaggtctggttatctgtgattccataaccattgctgtggcctaaattatctgttttactcatgaatctccaatttgggtgggacttagtggggacagttaatctctactcctcttgacatcagcaagggaaatttgaagactgaggtctggaatcttatgagggctcgttcattcataagaccagcagttgacattggctgttgtctggaatcagtcacagacccacccaggttcaaggaaaggggaaatagattttatctcttgatagaagcatagtagcatcctggaacaccagaatattactgtgctcatttttagaaatatcaactgccatagtctatcttctgtccacaacagttcatattcctcccacatgcaaatggactcattcctaccacccaaagtcttcccattttggcaacatgcttaggtttgaggtccaagatcttgtcacctaaatcaagtccagatatgggttagttttcttaggtgcagttgctttcagtgtaaagactcgggaactaaagagacaagttaccttttccccacacatccaacatacaatggtgggacaggcatggaaaaaccactgtagaccttaatcagaaaggggaataaaggaggcacgccagggccactgattcataacagctctgatgctagttccttgatcaggaatgatctctaggaatgattctctacagctcttgactctaccctcaagcctccaggttacgctctcagaagcattaatgatctctaggaatgattctctacagctcttgactaccctcaagcctttaggttccgctctcagaggcattaatgatctctaggaatgattctctacagctctcgaccctaccctcaagcctctaggttctgctttcagaggctttctttattttccataaaatatagccagtgtttgagaccaattatttatttatttatttatctatttatttatttattgagatggagtctcactctgtcgcccaggctggagtgcagtagcacgatctcggctcactgcaaccgccgccttccaggttcaagcgattctcctgcctcagcctcccaagtagttgggactacaggcgtgcgccaccatgccccactaattgttgtatttttagtagagatggggtttcaccattttggccaagctggtctcaaactcctgaccttgtgatccacccgcctcagcctcccaaagtgctgggagtccaggcgtgagccaccacaccaggccatgtcattgtatcttttttagatggatgaatattaaatttatttatttattattttttttgagatggagtctcgctcttgtcacccagactggagtgcaatggcatgatcttggctcactgcaacctccgcctcccaggttcgagcaattaaccctgcctcagcctcccaagtagctgggattacaggcacgtgccccctcatccggttaatttttgtatttttactagagatggggtttcaccatgttggccaggctggtcctgaactcctggcctcaggtgatccacccgccttggcctcccaaagtactgggattacaggcaggagccactgtgcccagccatgtcatgataccttttttagatggatgaatattaaatttaaaaaacaaaatgatccgtgtgcgtagaaggaactaaaggggaaaaagatcaatctgaaaacaaactatatagaacagcataccagcttcatactaacatgataaaagcagaggctttgggtaaccaaaaagtatgctttttaagcatgagaataattctaaaggctagctatatcttttctttcttctaaaaataatttcagttaaagaatttacatataaagttcatttatcatcacccactgtgggtgaagctctgtcaggctccggagaaacaaattactaaacatgatcaactgcccttcacatactcataatctagtgggggagacagacacatacacagataattgccatacaatatggtgttcatggtattagcaagtgtgttttttttttgttgttttttttttaattttttttagtttcactcttgtcacccaggctggagtgcaactggcgtgatcccggctcactacaacctctgcctcctgggttcaagcgattctccttcctcagcctcccgagtagctaggattacaggtgtgtgccaccacgcctagcaaatttttgtatttttagtagagatggggtttcacaatgttggccaggctggtcttccaactcctgacctcaggtgatccagccgcctctgccccgcaaagtgctgagcttacaggcgtgagccaccgcacctagctggtattagcaagttgtaagaaaagagttcctgtaatcccagcactttgggaggccgaggcgggcggatcacgaggtcaggagatggagacaatcctggctaacacggtgacaccccgtctctactaaaaatacaaaaaattagccgggtgtggtggcgggtgcctgtagtcccagctactcgggaggctgaggcaggagaatggcctgaacctgggaggcagaggttgcagtgaatggagatcttgccactgcactccagcctgggcgacagagtgagactccgtctcaaaaaaaaaaaaaagaaaagaaaagaaaagagttaaggagccattaatacttcctaggagctagtaaggaaaagtcaccaagaagacagcatgcaagtagggccttaaaagatagaagttcaacagaaaaaggaggaaaggctattaaaatccgagaaagaaatagcaatggccaactcacaggcataaacataagaattttgggaaatgcatacatttcagtttagctaggtgggggtttgggggtggcctcattaccactggttggaggtaaaagtcccaactctccacttggccttgtctgacaccatcccacctgagaagggaagggcacctctttgccaccaggtacaggtgaaattccatgttttacatgtggtgggctgacaagtgtgaggggcaagtattaggagagggccttgttactgtccattgaggatgaaagtctaagcttccccctgtgtattctctgacatgaacccagaaatggagaaaggaagttgagtggtctcattagaacctggcctttgctggtgggggtgggggttgggttgtagtttttttcccgtggtacttatctggagtagagacattatcatctaaaaatgttctgtcttgcaaagctgctgctttcctagtcctttgactagacagagcaggcttttcctagggctttaaaaaaaaaatgctgtgcccattggcatttctgggttgccagcttctccagtacccaatctgggatatataaaagaaaacccagggaactcatttctgtgtattccttgggttccagatccttaggtggtctgccttcttgtcacctttcagattcttcttacatttgttttatgtataatgttttacatatagtgtccagggtttttagctgcacctaactgaaggaatagggaaaagtaaatatactctttctataagtggtagtctgaggtcaattgatttgttacaaagctgccaaggcaatgctctgtgaaagccaccattaaaagaatgcaacagtgggcaacaaactgggagaaaaatacttgtagaacacttatcagacataagacttgtatctaagtaagaaaacaaccccattttaaaataggcaaaagacgcttcaccgaagaggatatacagatgggaataagcacaagaaaacatactgaacatgattagccataagagaaatgcaaagtaaaatgacagtgtcacagctgggtgcagagactgtctccagatgctgagacaggagacatctccagatgctgggctcacttgagcccagggtttcgaggctgtagtgtgccgtgcttgcgtctgtgaatagccactgcactccaccctgggcaatatggtgagaccccgtctcttaaatcaaataaaatcatgatacaataccactacccacctaatagaatggctgaaataaaatacattgacaacaccagctcctggtgaggatgcagagcaactggaactctcatacatgactgataggaatgcaaaatagtatggccactctagaaagcagtttggcattttcttgtaaactttcaaacagttactatatgactcagcaataacattcgtacacattttgcctagagaaatgaaaaatttcacatgaaaacatgcatgagtgtttagaacagttttgttcttattcaccaaaaactggaaataaccaaatgtctttcagtgagtgaataagtaaactgtggtacatttatacaatggaatactactgagcaataaaaaagaggtaagatacacacaagaagttgggtgaatctcaaaggcattattctgagtaaaagaagccaatatccaaaggttacatactatatgattccatttgtatgacattctccaaaaggtacaaatatcacaacagcatacagatcaatggctgccaagggtttggagttgggggagggtgatggaactgctttgtattttgattgtagtggtagttacaaaaactttgttaaaatttatagaactgccgggcacagtggctcactcctgtaatcacaacactttgagatgccgagtcgggaggatcatgaggtgaggagtttgagaccagcctggccaacgtagcgaaaccccgcctctactaaaaatacaaaaaaacagccaggcgtggtggcgggcacctgtgatcccagcaactcaggaggctgaggcaggagaatagcatgaacccgcgaggcggagcttgcagtgagccgagatcacgccactgcactccagcctgggcgacagagtgagactccgtctcaaaaaaaaaaaaaaaaaaatctataccatgaaaagtatgtgatgctgtatgtaatattttagaatttatttactgtttttatttatattgctaagagtcatccatattgtcgcatgttgctatggttcatttattttaactgttgtttctccattgtgtgaatttatccattttttcacccattctcccattgatgaacattttattgtttttgttcatgtgaacagtttgctctgaatattcttgttcatgccgcctattgaaattatgaatttctctaagtcatttgaacccaagacttagagaaattgttgggtcaacttttgtcctaaagttaaatattcatgtgttcaactttaggagaaaatgccaggccattttcaaatgttagacataatatttgatactgtgagaatgagaataagagtgtaaaagtggaagcatggagatcaatctttgggatgctcccactgcactctgctctttgtccaagagacttggccaaattccctcttttttagaagcctcacctcctcccacaccaggcacaatcagttttcctcctgtaggttcccaaggcacctgtttcatgccatactttaggtaattatcagactgtattgagataataattccttctagcaggtaggaagcttctagaaggcataggccaagattctttgtattctccatgcccaggacctagatgagcacaataaatatttcagtaaatgaacgttcttcctcaaatctatacccccactttcccagtatcagataatgaatgaaatttattctttctttaataatatagaatataattgcttgtttccatggtagttgccaatgccaaagctccttgaaggaaggaactacaccccttttttattatatccagcctttaatatagtgcttggcaaattgtagattcttgaaaagcgtattgaatatgtttaataaattgaaacttgcagcattttaagagtgtttattcacagcctgggcaacatagtgagactccatctctataaaaacattttttaaaaattagccaggtgtggtggcatgtatccatagtcctagctacttgggactgaggcaggaggattgcttcagctaaggaatttgaggttacagtgagccatgatcatgccactgcactccagcctaggtgaaaaagtgaaaacctgtctcaaagaaaaaaaaaagtgtttattctgaatgtcagttaccatggtccaatgctggagataaaatgtagaagatttagctacttataaatatgccatgatgaccgtagaacatatccatgcatgtggcttaaaaaacaaaaataaaacaattcttggatatcaaagggtgagatttcatttatattatataaagttcaaaagcagttgaaaataatctatagtgatagaggtctgaatagtaaatacctttagggagcgacctatagaacacgtgggagcctactaggatgctatcaatcttctatattttgatctgagtaggggctatatgtatagatattgcatatgtgaaagtttattaggctgtacgtaaatgatttatgtgctttatatagattgtatctcaataaaagtaaaaagcactataatggtggattcgtggcattatacatttgtcataacccatagaatggacaacaccaagagtgaaccctggtgtaaatgatgggctttcagtgactgatgctatgtcagtgtaagtttattgattgtagcaagcacaccgctttggtgcaggatgttgatagtgagggaggttgtgcatgtatggggatgggatatacacaatatccccaattttgctatgaacttaaaatttctctaaaaaatcaagttgattaattttttaaaaagtgaaaattaaaacagggcaggcatggtggctcatgtctgtaatccca

SEQ ID NO: 643 - DNA, 2882 bp, Homo sapiens
agtggcagctcgctgggggacccaaacgctgtgctcgccgggcacatggagcgacagcctagaccgagctgccgcttcgatcactgccccctgcacccgccgtggccatcccggagccccggtggaagcaacgccgcggaaacatcatatttgaaaacaaggtggggccttcatcatatgcaaccttcatattttagggcctgcctctttctattccttgacataaaccggactcttcatgctaatcaggctggaagtgtatcataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatacagcagcaatttcaacaaaagcagccatattagtatgtgccatgctatattctccagtccaagaaggttattagaaaattgtttaattgaggccaggcgccatgactcacgcctgtattcctagcactttgaggccgaggcgggcggatcacgaggtcaggagatcaagaccatcctggctaacactgtgaaaccccgtctctactaaaaaaatacgaaaaactagccgggtgtggtggcgggcgcctgtagtcccagctacgcaggaggctgaggcaggagaatggcgtgaagggcgcttgcagtgagcggagatgcaccactgcactccaccctgggagacagagtgagactccgtctaaaaaataattgcttaattgagaaaaagttgcttttgtcgctggaattactgtgagataattgaccgtgatgggagctgtgtcccccagatgaaagcaaatcatgggagccagggtcaatcatattaatgtctgcagtgaaaagaggtgttgtgatcatcataagacataaccataaaatacttaaagtcttaaatggccaaagcctttaaactacattataatgattacagatccaataaagtttaattaaaacaaaactactacattgaacatccataatgattagaaaggtttctaattggggacaaatttggtattgagaacacatcaaaagaatttcccacgttctttgttacatctgtttgtgctggttttctgcttctgcatctgtacagggcacatttctaaaaaactgaccagtttaaaaattactttttaagtttataatgctcattttaggtaagtcattaactctttccataatttaggtgatcatttaatgttttagggattgggaagcacagcttacttttagttaaaaaaaaaaagcaaaaaaaaaaaagcatgagctttggaatcaggcagcctggggattctaggctagaattctaggtttctcatgtactaattgtgcaatttaactgcataatctctctgtgtccatagggtcctcaaagaaaataataggaaattatggataggaaataggaataataggaaagatggaattccaaagataatgtaataaagggaggtatgataggttaggggaattaacaaggaataatgaagcactccggaacccagcagcagcagcagcagcagcagcagcagcaagaaacctttactatccctaaggattagggcaagagagaagaaatagggagttacagtctgatgagaagaggagccttggaagaagtgttgactgacaggagctacggttatggagtgaccaaccccagtcactactatggcagaaaataaataccctggtatttttcttctcttctcttctgatctcttgcaggaatcaccctttggccaaacccaattagacaaccagaaacaagtcagcaaaaaaaaaaaaaaaaactctgggtggtgcagtcaatagtggtaagccctctaggcactgaaaaaaggccagagatgagcagaggaattgttctgtgttaggggggatgaaagtagaaaaaagcaatttacgctctttgtttctttttcctcatcttttcttttctttctttcttttatgaggcagagcctagctgtgtcaccaggctggagtacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgtttactggcataagccacagcgcccggccctttttccttgtttctaagtggagatatgaatcaactcttgtccaacaaaa

SEQ ID NO: 644 - DNA, 3196 bp, Homo sapiens
acgtgctggccctgtccacacagacgtcgactccagcaaaaatgtcctgactgacttcaggagagaggaattattgctacgtgcctctttcccagtgaagaaaatctctgttggctgcgagcagagaagcggcggaaggattcccgactccgggaagccaggtgtcggaaggaggaagtacgcttgaagggggtccggctggccgactctgcactcgtccgttcgtggcccaccgtggtggtcaccaaattgagggcttcctggaaggacctcctcacggtgcccatccactgggtcatgtgggtctgggccactgtgagtttatctcccaggtaatccatggggccagccaggaggagagggaagaaggaagttagggagggagagagcaattaaaacgccagtgtcctcttgcctctttggactcttttgctcatggaagttttgggcttgcttggaggaaaaaaaattaaaaacagcagctttcttcaggcaaaccaagggtaagtaaacatccctgagccaggagccggctgcatccacgggtgccgctcagaattaagaggcagctaagtgccaggctgggagtccaccccagcggagttataaagtcaacacactgggcagtccaggttccagttccagggctcacccagctgatcggccgagacaaggagctttgaggaacaagccggctgcactcactccagggcgtgacggtcccgaaaggcgggggatggggatgggggtgggggtggagggggcggcctttgggcaccctcgtcctcacttcccttcaggtaggcagcccccctgaggtgcaccctgggaggttccggtgggcaagctgccgcaccctgctgccccctgcccggctgccctcggccagaccccgctcacctgacccatgcaggttttctgtcctctggctggagattccaaacctgtcggccggcaggcggctagctcacttccggaggcagccaccagggcccccgggtcccctggctgagcagcccgggatgacatcagcccccgtcttagcgaggggcttcgctgcccaggaatgcaggaggggcctcggggaggcggaggcggtggcggcggccgcccagggagctgacgtccgcccccatttttttctcccccaagtcccaactcgctcacggtccctcggggctgatggcaacttcacgtgcctgccagcctacccacccctgtgccctcacagcaagcgcaccaggaaatgcggctgcacgtgtgtgcatgtgtgtgcactctgtgtgtgtgtgcgtgtatgtcggcgatctggcagccccgggaaggttagcactgctgggaaacggcttctgcctctaaggttacaggcagcgtcttgggacctctggtcggctgtcagtctgtctccctctcgtggtctgtttctctgttgatttctcagcctcgctctcctccctctccctgtgtctcaacttccacttgcttgtctctaagcgtctctcctctctctctccttttcagctgtctctccctccctctctggaaggcaacactgatccaggtgagacagcctctgaggtcccccaggaaggactggggagggctgtatttcagtacaggcggagttgccatggcaacccggggcacagcatctgccctgtcctgggcagcaggctcagcactgggagcaatgggaatgattcatggtttacactaggtcacgtgagctccctgggttttaacccttacagggctggagtactaggggttgggggtacgactagaccctaacacccactgtcctcggccaggccccgctcatctgacccatgcaggttttctgtcctctgcctggagatcccaaacatgtcaggggttgttagaagggggtgggcagcagctggatcctggaggtcaggcacacctgttaaaggaggtttctccttctagcagggatccatgtccccccaaccccactacttttacagacaaggaaatgcagattcagagacatagattcacttgcccaaggtcacacagcaaggatgtcaccaggcatgcaccagagctgctcccaccccaggttttcccaggtctgacatggtacctggcccagagtcagggctctgtaaatatttattgttcggacaccaagtacacaattgaaacccaggtcgctcagaatgcatcctatgtcctttccaccaccacctcacttcagttttgaacaaatatttgttttctagacactggtcaaagggcctcacttgagaaagtttatcacaaaggactctctggcaatatggccaacagatctctttcttttctatgtattcccagtccttacagctattcattctctttctctccctgtctctcttcttctttttttggatacaggatctcactctgttgcccaggctggactgcagtggcatgatcacagctcactgcagccttggcctcccaggctcaagcgatcctcccacctcagcctcctcggtagctaggactacaggtggagcaacaccgtcagtcagaaggcagcggatggcacagggcttccgcgtaaggcctgcatcgcctgagtcatggttttctcatcttgtatgaggcccacccccttcaaaaggttgtgacaaaaaaaacaactgagataatttgtgccgctggcacatagttaacactcaataaggccgggcgcagtggcttacacctctaatcccagcactttgggaggctgaggcaggtggatcacttgaggccaggagttcgataccagcctgaccaacatggtgaaaccccatctcaactaaaaatacaaaaattagccaggcatggtggtgtgcacctgtagtcccagctacttgggagcctgaggcaggagcatctcttgaacccgggaggtggaggttgcagtgagcggagatggcaccactgcactccagcctgggcgacagaacaagactctgtctcaaaacaacaacaacaacaaaataataaatggtgaccacaagggatgatcgtttttctattataattcctatcatctcactgttcaaatgaatcacaggaccctagacagtcagaatcaagacaccagcagggaccaacctaggccaaccttcccactaaactgaagaaacaggcccagaccgagggctgccctaaggcctcacagtccatctgcagcagg

SEQ ID NO: 645 - DNA, 2469 bp, Homo sapiens
acttctctgagatgagggcggcaacaggagcaaatgcgagcagacagctggcagaagttctgcaagatgacctgggaataaagttggccaagaagcctccgaggggagatcggcgtggtggagagccccgcgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaataaaagccattctgacaggtgggcggtgatacctcattgtggttttgatttgcagttccttgatgattagtgatattgaacatcttttcatttacctgctggccatttgtatgtcttcctttgagaaatgtctattcctgaatagcttttgcccattttttaacagagtcttttaaaatattgagttgttttaggtcctcatgtattttagatattccttatcagatgtatggtttgcaaatacaatatttcctctcattctgtaggttgtctctttactctgttaatttttccctttgctggacaaaagcttagtttgatgcaacccattcgtctatttttactttggtcacttgtggtttttgagtcatattttaaaaatcattgcccaggccaatgttatgaagctttctcctatttccttctactagttttacagcttcagaccttatgtttaagtctttaatccattctgagttgatttttatctatgatgtgagataaaggtccaatttcatccttctgcatgtggacatccagctttctcaatatcatctatcgaagaaattgtcttttccacatgtatgttcttagtacctctgctgaaaatcaattgatgttaataaattcagtcaagttgcaggatgcaaaatcaacatacaaaaatcaataggatttctatatactaacaatgaactatcagaaaaagaaataaaacaattctacttacaatggcttcaaaaaaagtaaaatactttggaataaatttaaccaaggagatgaaagatctgtgcactgcaaactttaaaaccttgatgaaagaaattgaagacacagataaatggaaggatattctgtgttcatggattggaacaattaatattgttaaaatgtccatattaccgaaagtcatctacagattcaatgcaatatctatcaaaattctaatgtcattcttcacagaaatagaaaaaatagtcctaaaattcatatggatccaccaaaagcgctgaatacctaaggcaattgagtaaaaggaacaaagctggaggtatcacacactatctgatttcaaaatgtactgtaaagctaaagtaattaaaacagcaaggtcctggcataaaaatacacagactaatggaacagaatagagagctcagaaataaataccctgataaatttatcttcagaaagttattattttctaaagttgagtactcataatatgagagaacatgacttgactagactgagttttatctctgaaccaggaaacagtggacacatttcaagatgggtaactgtaaattatggcctctcttaaggatttctggagctggttttaatgtttcaaagaatctcaaaatgcgctaagagcagaggggcaagtgtgtaatcccagccttttgggaggctgaggtgggagaatcacctgagcccaggagttcgagaccagcctgggcaacatggcaagagcccatctctacaaaaatttaaaaaattagctgaatgtggtggtgcacacctgtagacccagctacttaaagggctgaggtgggaggatcatgtgaggctgggaggttgaggctgcagtgagtcatgattacaccactgtacttcagctttggtgacatagtgagaccctgtctcaaaaataaaacaaaaggtgtgattgttaaataaaaagactaattttctcacaatctgcgttagtttactagggataccataacaaagtactacaaactgggtagtgtaggcaacagaaatttctttcttcccagttctggaagctggaagtccaaggtgtcagcagggttgatttcttctgagggcctttttccttccttccttcctttttccctccctcccttccttccttccttccgagacagagtctcactttgtcacccaggctggagtacagtggtgcaatctcg

SEQ ID NO: 646 - DNA, 2489 bp, Homo sapiens
acttctctgagatgagggcggcaacaggagcaaatgcgagcagacagctgggtgtgtccctttccagcagagggaagttctgcaagatgacctgggaataaagttggccaagaagcctccgaggggagatcggcgtggtggagagccccgcgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaataaaagccattctgacaggtgggcggtgatacctcattgtggttttgatttgcagttccttgatgattagtgatattgaacatcttttcatttacctgctggccatttgtatgtcttcctttgagaaatgtctattcctgaatagcttttgcccattttttaacagagtcttttaaaatattgagttgttttaggtcctcatgtattttagatattccttatcagatgtatggtttgcaaatacaatatttcctctcattctgtaggttgtctctttactctgttaatttttccctttgctggacaaaagcttagtttgatgcaacccattcgtctatttttactttggtcacttgtggtttttgagtcatattttaaaaatcattgcccaggccaatgttatgaagctttctcctatttccttctactagttttacagcttcagaccttatgtttaagtctttaatccattctgagttgatttttatctatgatgtgagataaaggtccaatttcatccttctgcatgtggacatccagctttctcaatatcatctatcgaagaaattgtcttttccacatgtatgttcttagtacctctgctgaaaatcaattgatgttaataaattcagtcaagttgcaggatgcaaaatcaacatacaaaaatcaataggatttctatatactaacaatgaactatcagaaaaagaaataaaacaattctacttacaatggcttcaaaaaaagtaaaatactttggaataaatttaaccaaggagatgaaagatctgtgcactgcaaactttaaaaccttgatgaaagaaattgaagacacagataaatggaaggatattctgtgttcatggattggaacaattaatattgttaaaatgtccatattaccgaaagtcatctacagattcaatgcaatatctatcaaaattctaatgtcattcttcacagaaatagaaaaaatagtcctaaaattcatatggatccaccaaaagcgctgaatacctaaggcaattgagtaaaaggaacaaagctggaggtatcacacactatctgatttcaaaatgtactgtaaagctaaagtaattaaaacagcaaggtcctggcataaaaatacacagactaatggaacagaatagagagctcagaaataaataccctgataaatttatcttcagaaagttattattttctaaagttgagtactcataatatgagagaacatgacttgactagactgagttttatctctgaaccaggaaacagtggacacatttcaagatgggtaactgtaaattatggcctctcttaaggatttctggagctggttttaatgtttcaaagaatctcaaaatgcgctaagagcagaggggcaagtgtgtaatcccagccttttgggaggctgaggtgggagaatcacctgagcccaggagttcgagaccagcctgggcaacatggcaagagcccatctctacaaaaatttaaaaaattagctgaatgtggtggtgcacacctgtagacccagctacttaaagggctgaggtgggaggatcatgtgaggctgggaggttgaggctgcagtgagtcatgattacaccactgtacttcagctttggtgacatagtgagaccctgtctcaaaaataaaacaaaaggtgtgattgttaaataaaaagactaattttctcacaatctgcgttagtttactagggataccataacaaagtactacaaactgggtagtgtaggcaacagaaatttctttcttcccagttctggaagctggaagtccaaggtgtcagcagggttgatttcttctgagggcctttttccttccttccttcctttttccctccctcccttccttccttccttccgagacagagtctcactttgtcacccaggctggagtacagtggtgcaatctcg

SEQ ID NO: 647 - DNA, 1377 bp, Homo sapiens
ccatatattcattaatcaacttgtctcatagagtgtaatagccactctaattatttttttcaaagtgttctcagctgttcttatttgtgttttcatctataggagttctgcaataaaatgcctgctttctccaccagatggtatgtctattgggacaaaattaaatttttgaactacttgtaacaaattgatgattgagtaatattgagtttttctatcttagaacatgatgtggttttccacttttttatgctgattttctcatatttcaaaaactttttatgatctttctcatactttttacaaatttttgttagatttatgtatggctagtttattttactttgtactgttaaaaagtaaactgtagcacaatacaaattttaaaagttttattggctgggaatgatggcttatatctgtgattccagcactttgagaggccaaggtgagagattacttgagcccaggagtttgaggccagcctgggaaacatagtaagaccctatctctatgaaaaaataagaagaaattagctgggtgtagaggtccattcctgtacttgtagctactcatggggtaaggtgggaggatggcttgagctcaggatgtaaggcttcagagagctccgattctgtctatgcattccagcatgggcgacagagcaggaatctgtttcaaaaaacattttcttgagtaggaagcaactaatgaattgtggaacatgagaccaaaaaaggtttagcatttaaatgacaaagtgtcagaggtaagattgtattgaaaatatgcagaaggaaaatattaaagttatttgattagttgcagttaaaaaactgtcttttttggtttaccttatagacatatattactataccttcttgggtacttctgataaacttaagttctgttattgttgatttttaatacaggtattcacaaaaatagctcacattatgttttgcttgtttgcaagtcaacaagatgaggtcaccgaaaaggtctaactgattctgtctgctcaggaatgtttcaggcttggtctcccttttaatttacctcgtaaatcattttgtaatttttatctcctacccattctgtaacttgttaattacttttatacacatgtaatatcttttatgtgtgatttctaagtatattactagtgaacattgactgttacaaggcataccttgtcttattgcaatttattgtgcttcccaagtgttggatttcttacaaattgaggggttttggcaaccttaccttcagtgactctgtcaacaatattttttccaacaccatgtgatctgtgtgtgtgtgtgtatctttgtcagcatttttatcaataaagtacattttttattaaggtatata

SEQ ID NO: 648 - DNA, 3701 bp, Homo sapiens
ggattctggaggaggcctcggcgcgcagctgggcgagtactaactgtttgcactctcatcagacctgcctcggtcatgggagaagttgaagactttctgcaatgcagcatcttcaagcaatacacacatggatgaaaatcctaaagtttgcatgaaggaccaataacgtgcctagaaacaggcaaagtgagggagctcctttgctagatgatcttcagagcctctcccagctgtgaccagaaatggaaagccagagaaggtaagtgacttgccaaacttatggaatcagggcactccagttggtgggctgggctgataaacagaaatgttacataaaatacttctctcctgatttaacaacaattaactttagggaattataaaacaagatggaggctgggcgtggtggctcaggcctgtaatcccagaactttggaaggccaaggcaggtggattacctgaggtgaggagttcgagaccgacctgaccaatatggagaaaccctgtctctactaaaaatacaaaaattagtcagacatggtggtgtgcgcctgtagtcccagctacttgggaggctgagacaggagaattgcttgaacccaggaggcagaggttgcagtaagccgagatcatgccactgcactccagcctgggcaacagagcaagactcaaaaaaaaaaaaaaaaggtggaaataaaatattagacaaataaaaaattttaagttattaggtagaggtagcgacatggagtgaacggcctttctcaatttcataagtaagaaagatagataattgatggaacttaggctttggtaagtatttattttaaaaatttaagggtatctctttgctagtatatataattcccaaactagtagacagggggaagggaataaagaaaacacaatcaactcaatagaaggcaagaaaagaagagaataaagaagcaaagaacaagcatggaaaataaaactcacaacgtaaagtgcaaaaattaaaggcacacgactcaacagcaaaaaagcaaaagaagaaatttataaatgggcaaaggacctgaacagatacttctcaaaagaagacataaaaatgaccagcaaaaatgctcagcatcacatatcatcagggaaatacaaattaaaagcataatgagatgtcaccttacactgttagaagggctataatcaaaaagaccaaagacaatgggtgtgggtgaaaatgtggaggaaagggaacccttgtacactgttgatgggaatgtaaattagtgcagcctttatggaaaatagaatggaagtttcccaaaactctaaaaacagaattaccatatgatccagcagtcctacttctgagtatatactgtgaaccctgaatatctgagacagttctcagttaatttagaaagtttattttgccaaggttgaagacacacactcatgacacggcctcaggaggtcctgatgacatgagcccaaggtggtcagggcacagcttggttttatacattttagggaaacatgagacataaatcaatatgtaagtgtaaggtatacactggttctgtccagaaaggcgggaaaactcaaagcagggagggggcttccaggtcactggtaggtgaaagacaaatagttacattattttgagtttctgatttgcctttccaaaggaggcaatcagatatgcacctatctcagtgagcaaagggatcactttgaatagaatgggaggcaggttgtccctgagcattttccagcatgacttttccctttagcttagtgatttgggggccccaaaatttattttcctttcacaatactcaaaggaattgaaatcactatgtcaaagagatatctgtgtttccagaaagaggtcccagtccagaccccgagagagttcttggatcttgtgaaagaaggaattcagggtgagtccatatagtaaagtaaaagcaagtgtattagtaaaataaaggaataaagaatggctactccataggcagagcggcccgagggctactggttacttgctgttatggttatttcttgattgtatgctaagcaagtggtggcttatttatgcctccccgttttagaccatttagggtaacttcctaacaggtcatggcatttggaaactgtcagggcagtggtgggagtatagcagtgagaactctcgttgccatcttggttttggtggggtttagctggcttctttacagcaaactgttttatcagtgaggtgtttatgacctgtatttggtgccgacctcctatctcatcttgtgacttagaatgcctaaccatctgggaatgcagcccagtaggtttgtttcagccttattttacccagctcctattcaagatggagttgctctgcttcaaatgcctctaacatctgtaccccataaaaatagacaattattatttgttaattaaaaataaaattaaaaagtgtatcatgaactgtgttccctgtcattaaatgtgtgccttccccactaaaaacatacgttagtgaacacagtaaatgttaacagatttaacatttaattaatttaattaattaattaattatttaatttaacatttaactgttagtctatcctaacagttaaatgttaacagatttaactgttagggtagactctcagattagaatccaattggaagtgttttgttttgttgttttaatctagctatgttgcttttcaaaggtacacctaaaacaaacttatagacaggttgaaaataaagagggaggatagaataatatatggcaggcaaccaaaagaaagttgttaatgcatataaaagttagtaaagaaacattaaaaagatgcttttaatggtaaagagaagactcattaaagatagaatactattcacctataagcaactgacaacatagtcccatattatctagcacaaaaattgacaaaatatgaggaaaaattcaaaatccataattattacagaggatttggagtacctctatcagaaaacaataaatcaagtaggccaaaaagcatatgaagaatatggaagacttaagtaatatattaagaattgtgatctctgaaaaacagtgacccctgaagaatagattgtttccaagcacatttcaaatacttacaaaaacttgaccattccctagaccacaaagaaagtttcagcaaactcagatcctatcacatagaccagattttctgacctcgtaattccagtagaaatctatgaatttattcattttctacacatacatacacgttcgaaaatcaaaacacactctaaataattcatgagtttacatacatctgagaatgggcaagacccaattatgtctgttgtcttcgtgtgattattaatagcactcttccactcactgtcaaacatgtcccagtttggttgatacgttatgtggacatcctatttaaaaggaaaattataaaacatttggaattaaatgacaagaattccctgtcaaacttctgctttactcctgaggtaataatttgagggaaaacagcctggaaaaaataaactggagtttcaactcaaagagtaggataaaaagaatcaaaagggaaatcacaggcaccaaaaaatacataaaaaggggtgacaaaagtaaagacagacactgatgaaaatgagaactattgcattagttttctgtctagctgcattcgaagctggaa

SEQ ID NO: 649 - DNA, 853 bp, Homo sapiens
atggcttctgcagggtggactggcctccttccccctatatgtgtgtctacggctgacctgtggctttgccgaggctgggaagctgctggtagtgcccatggatgggagccactggttcaccatgtggtcggtggtggagaaactcattctcagggggcatgaggtggttgtagtcaggccagaggtgagttggcaactgggaagatcactgaattgcacagtgaagacttattcaaccttatacaccctggaggatctggaccaggagttcatggcttttgccaatgctcaatgggaagcagaagtacgaagcttattttctctattaatgagttcatccaaatgtttagaatttaatttttcacattgcaggagtttgtttaatgactgaaaattagtagaatacttaaaggagagttcttttgatgcggtgtttctggatcctttagctatgtgtggcttaattgttgccaaatatttctccctcccctctgtggtcttcaccagaggaatactttgtcattatcttgaagaaggtgcacagagccctgcttctctttcctacagccctagatatgtctcaggattttcacatgccatgacttttaaggagagagtatggaaccacatcttcttcttaaaggagcatttattttgcccatattttttcaaaaatgccttaaaagtagcctctgaagttctccaagcacctgtcatggcatatgatctctacagccacacatcaatttggttgttgtgaatggactttgttttggagtatcccaaacctgtgatgcccaatatgatcttcattggtggtatcaactgcaatcagggaaagccagtgcctatg

SEQ ID NO: 650 - DNA, 1469 bp, Homo sapiens
gaatgaactctaatgtaagctatggatttggggtcataaatgtgtataaatgtaggtttgttgattgtaacaaatgtaccactctcttgtatgaggctgatagtcggggaggctatgtgtgtgtgtcagggggtgcagagtatagatgggaacaccctctactttgtactcaattttgctgtgaacctaaaacttctctgaaagataaattttattttgaaaaacactatgatacactaaaacttcttttgtccttatttggtaatacttagaaatataattttattaagattatatttaaaagtagagtcaaaagatatgcatgttttagtgaaatatcttctattgttattactatcatcatagttattattatttgacttagaaatcctcagtagacattatgaaattagagatcagtaatgttctagttgaaaaagacatatacttgataaaattgcttcttattcttttggcgttactgtggttaagagtcttgtgctgtaatgatctcagttaaaaatagtaaaaagaatctcttgaatattgtggtggactctgcacagttcatgcaacaagaggcatggttacctgcccatatagctttgtttgtatcagccagttgaaatgtcaacatggttccttatccactgaataatttcacaaccctcctcttaatttggttgctttggacacattctatcctggaaacaaaatctaggcttcataatacattcggaaataatagattcatgttctttttttccagctggtactggtagagtttacacatttactcctgcaccataggaacagctgcttaaaaagctgaagtgtgtatttgattccattacattggcacaatagaaagtcatgtaaaagagggagactctctcagcttctccatatttggaaaattaattcttttaagtgctttaaaaaaaatctctacaggtggtcagactctatgaacttaggaccagaaatgacctcatcaccttcagctggtctaaagttgtctttggctgctgcacacttcacaaaatcttgttaattatgattgtttttcctagttataagtccttctggatacatttttatagcatttatttttatcgcttacataactacataaaatattttcattggtgtcaaaatgtcatgttattgccaaatagattccatttcaatttctagaaattattggaaagttaatacccacattttaatggcacccttgctgtggtattaaatcatgttttattgaaattcacaagaatcaaaattacgctgcgtttatccagaataaagcactagaacagttactttttggccgtcttgcccattaatttctatgcttgcactttctctttagacaaacaatgaatgaaatttagtgtctttctagaattgaattctcatgaaagtgattgtcatatacacactcatcatctacttctcttttcagc

SEQ ID NO: 651 - DNA, 2531 bp, Homo sapiens
aggcactgctggcatcctggccggctgcgtttgcactgcttctccaaaaccacattataggtactaaacaacattgtttagtacctataatgtgctagactcctggctgctagcgaggtaaagttaaacatagtttctattactgagctctcgtaattattgtcataacaccacttagattgtggaaatatctgtcctcacaccccttatattaaaggtgtgtgcatttagaaagcaaaacgtcttgttagcattaaaaatctgaatcgtggctgatttcttttcttttctttttttttttttcgagacagtgtctctctctgccgcccaggctggagtgcagtggcacgatctctgctcactgcaaccaccgcctcccaggttctaagcgattctcctgctccagcctccggagtagctgggattacaggcgccacaaccacgcccggctaatttttatatttttagtagagacggggttttgccatgttggcccggctggtctcgaactcttgacctcaggggatccacccacctcggcctcccaaagtgctgggtttaatggcgtgagctacagcgcccggcctgatttcatgttttatgtgaaattaacttgtttgcctgggttaacagtaattaactgataattacataatatttatcaattttttcagttaattgctgacagtgtaagaagaggagccaaatccatttcagacacagtatgcaattgtgttttaagccccaagagtagttactttaaaaaagctcacattattttaaatttcaaaatacatgccaagacagcttgtcattttctttggtaagacatctaattaagtagttaactaagaatcaaatctgtgaagtaggactaaatagtagtgggcttcctgtactagataatatacatatatggtctttatgctgaaatgtattatgtgcctactttatttttgtcttagtctgttctgcataggtaaatgtttggattatttcaccaagctgactggccagtatcaatgttaccagactactgggtaaaattattaataatgaaagctaatgttttgtggtttgcacagtcgcattgtttttgtctctgcttagacaaaattataaactggtcttttttttttttttcttttttttgccttgcttcaccacagtcacagagtgaccctctctgattagttggtgttcgataggaaaatcatagcctagttgtgaatgtcaagctatctcccaacactgtggtgtagctgtgtcaggtcagtccctggatgtcagggatgattttctcatgactattagatctggctaaaaaatgcatattaaatagtagtgtcagtgaactgaccctttagatgaatattttcccttctatttttttcagtgaccaattatagatgtttttctccataaaagttattctagcttaagaccaaaataatttagaggagttaatataattaaaatacagtagttcttatatgcaataggcagtttcagttaccaagggttaaacatgatcttgaggcaggagaatagggtctcctattgaggcagggaacctaaggccgattcatgctgacttcctagagctaaatcaaaaggaaaaccccaacttcccatacctaagtaacaaaaggacccaaagctacgccctttgcaaacccctctttttttctgcgtggcagatagaaaattgaaagtatctctgcttggtagctttctgcaaccaatcagacgtttgcgtaggagtgtaactttgtaactttgcttcagcctctaattggttgtttttcacaaccaatcagactgattgtgggctagtacttcatttacatttacataaggtgtacaccaagtaaccaatgggaaacctctagagggtatttaaaccctagaaaattctgtaaggaggcccttgagcccctatgctcagatggttcccaccctgtggcgcgtacttttgttttcagtaaatctctgcttttgttgcttcattctttccttgctttgcttgtgtgtttttccagttctttgttcaaaacaccaagaacctggacaccttccaccggtaacaatccgaaaatattaaaaagaaaattccagaaatattcataagttttaaattgcatgccaaagtagcatgatgaaatctcatgccatccagctccatcccacctgggacgtgaatcctccgtttatctagcatatccatccatgcaatagacattactctcttgttagtcacttaggagccattgcagttatcagatggactgttgcagtatcacagtgcccttattttagttctattacaatatattgttataattgttctattttattattaggtattcctcctaatctcttacggtgcctaatttatacattaagctttatcataggtatataggaattggaaaaaaatagtatatatagggtttggtattttccagggtttcaaacatccactgagggtgttggaatgtatctccaaggataaagggagtgggaggggc

SEQ ID NO: 652 - DNA, 2283 bp, Homo sapiens
ttctcctgcctcagcctcccgagtagctgggattacaggtgtgagccatccatattatataggtatattaaaatatcacattgtaccccataaatgtatacaactctgatttgccatttaaaaatactattaatacttttcttagaaaaaagagagaaataaactttaagaattgggccagagaaaaaagtgtttttttcatcttaaaattcaagacaaaaaatatttaaaaattttaatggaatgatatagtgacaaaacctatcaaaacctctgagatacagcaaaggccgtgctaagaggaaagtccatagctttaaatgtctacatcaaaaagtctgaaagagcacaatatactaaggtcacacctcaaggaactagagaaacaagaacaaaccaaacccaaacccagcagaagaaaggaaacaacctagctcagtgcagaactaaataagattaaaaagaaaaaaagacaaatgaaacataaacctggttttttaaaggataaataacattgatggaccattagcaagattaagaaaaaaagagagaatattcaattaagcttaattagaaacaaaacaggaaatattacaactgacatcacagaaatacaaaagatcattcaaggctactatgaacacctttacacacataaacacaaaaatctagaggagataaattaattcctgcaaatgtacaaccctcctagcttaaatcgggaaaaatcagaaaccctgaacagaccaataacaagcagtgagattaaaatcgtaatttaaaaaattaacaacaaaagaagtccaagaccagacagactcacagcagaattctacccaacattaaaaggaaaattggtaccaatcctattgacactattccacacgacacggtaagagggaacctccataattcattgtatgaagccagcatcaccctaataccaaaaccagaaaaggacatagccaaaaaagaagactacagactgacctaatgaacatactggcatactcaattataatataaactaaaaaaccaaaacaattaactcatgtgaggtggcatatcctaaaatatataaaacaaaaatataaaattccaaaagaaaattaaaacatgaaatgtaaaacttattggacaccatcaagtacatcaatatattcattaaaaaactcttagaagaagaatgtagggaaaaagtaatgtagaggttacttgtagatgaaaaaggctaagaacttcccaaattttgatgcagtaataaaattcctaaccaagaatacttgattcaagattagtgtactttaaaaacagataaaaataaagacttttcaaaataaaaggtgacagtgttatgattcattatgactagcacagttctacatgaagggctacatagtagcctggcaaagtggattatttctgtaatcccacatctttagggaggccaaggcagtaagataacttgagaccaggagttcaagatcagcctgagcaacacagtaagactctgcatataaacaaacagaaatgctaaaatgagtccattatttaaaaaaaaaaaatgatgctggacagcatcataaaactatatataaatataaagctattaaatgtaaatatacacacacacatacaattctttactctcataatgatggagcataaaacctttaaagttattctatatgagaaactaaaaataagtctgcataaatctgtcgatacccaataaaaaataatagtttttaacatcaacaaaaaactggaaaacatattagtttttgcattaaattgaagttgttatgaaattaaaatatattgttttaactttaagatgttttatgtaatctccacttttcaagataattacattgtatttccagaaagtatgtgaaacaaattttaaaataatcaaagtatgtcacaacaaacttaaccaaaaattggcagggcaaggtggctcacacctgtaatccctgcattttgggaggccgaggtgggccgatcacctgaggtcgggagttcgaggccatcctggccaacatggcgaaaccccttctctactaaaagtacaaaaattaactgggtgtggtggcaggtgccggtaattccagctactcaggaggatggggcaggagaatcacttgaacccaggaggcggaggctgcagtgagccgagatcacgccattgcactccagcctgggcaataagagcaagattctgtctcaaataaataaataaataaataaacaaacaaaaataagcactaaaatgaacaa

SEQ ID NO: 653 - DNA, 4159 bp, Homo sapiens
gttttgtcaaaggggactcttccaattccctgcctagggaatataaatctagttgccagtgccctaactgcaagtgagggaaaaagggtgggagtctcactaattagtatatggcatgtagacttgaccttgatcatcctttttcagccttactcctatcctctacaaaacatggtatcattgggtctgaaaatccctggctctatttccctagaaattaaaccagttgcctgctgggctggttggtgtacagaagaggagaaggattctgaggggtcatctccaatcccattttttttcagccccagcctgcatccctttctacagaagtaacaacaatttccagtttctgagcctttccagggttgtacagtaggtattcatttgctttttgatattttccacagcaaagcaaactttcttgctgctctgttaacttcgttaccactcacccgtctgccttctgtcttccaacattttgttgctagctcttgtctgctgttgcctcttctgttctctttatccttccaggttttataagattgtttttattccttttcagtcatttcagagaggcttcaggatggagttgtgataaacgcatgtgttcagtctacaatgtttaacagggagtgcctcttgattttttcatgtgaattactgaggagtaggtagtagactatcttgatgcccttcctcatgtccctttgactctgagttgacctgcagctgcagtgaacacttcctaaggatgctgatgtcttcccctatcaagcacttgcctcattctgcttctccgaggatttcctccagtacaccaagagcttgcccgacactcacaaggtatcctggaactgctggggactgaaaacccctcaacccatgaagaatgaggatcagtggattaatagcaactgtcccataccttggtgggactattataaggcattctggttggttcctcagaggtcccaaatgggattgaaccaaagttgcccacagtaaaaactcattcaccaactcaattttcatttcacccctctcaatttgcacactcactcacttgttctacctgggatactctccaagataaactcctgtatccaaagctttgtctcaaggtctcatttgggaggaactcaaactaagataataggtactggaagtgactacagaaagtatattatcaatggtatggaggcaacaaaaaccccattaatggtggtgagtaaggtggtgacaaaccctggcactttgaagaatttcattacccacaattgacccatggtgtacttggatgaggtaaaaatgaaaggagacgctaaccttatgcaatagtgctaactcctgaaagatatagggctgtgataatcacaggaattgaagagttgtcttgttcttgttaactcccctagaagaattgggaaaaaagaaagataggtttacaacatccaactacccattcagagcatagcaatgaaagccagaaggtctccttgggagaatctgaagagacccccatttcctgcaaccagagggcaggctgttctaaaaaaatgacattcaggggttcactgcaagaggaattgaactacagagcagactgaagacacagtccaggcaggcctctcatgcaaaagtcaaagccctagaggaaggaaatggtccttaaaaactactgggatgcaggcaggcatctggatagatgtgctagataaccttgaacccctagattccctgaacaacccaggctagcaggagtatcctgcaccctgttacttgaacagaacagcttccctttgcctagagactctacacagtcctcctctgaagcagacacctccaagattacttcaaggtctgctacttcctgccctcattgcctctattccaaaaactggaaacaagtctcagcatgccctgagcagggtagcacatttcttgctgtgagagatatgacagattgtattttctaaagaaggctgcaaccatgtctctcatcccaaatgctcttctacaatgcaatcttgtcactcctctaccaagagatgaaacctaatttcaatgcccttgaatctaagctggactttacttgctttgacctgtaatgtacagaagtgacactgtgtgattcttacagctgagtcataaaaggtgatgcagcttctgccttgttcctggggacatatgcctctgtgagattgagctactaaataacaagaccacctaccttgaggctgccatgctggaagaaagcaaagccacatgaagagcaagtaagctggttgctttagcaagatccttcatattgatagtgaatgtgcacttctgtctttctcttgtgaatgcaaaccactttttcaatagtctcacgttaagtgccaaagattgttgtttttgttgaatgcattctctttatcattcactacctggccctaggaatttgttcaatgatcctcatttctgttacaatatagtcttcagtgaccttgatcatcttcacattctatagaacatcatcctggcccattatattaatgacagaataataattgaacttggtttttaggaaggagcaagtatactggttttaaatacttcatgctgaaggaatgagagataagccctacaaagttttggaagtctgccacatcagggaatattttaggggcccaaagatccaggggtatgttgagacaccctactcaaaagaatactttacatttcctaccactaagacagaggcacagcacttggtgagctgctttgaattcctgaggcaaaaaaataacaataataaatactacccatgagaataatgctctgatctattgtatcagaagactattgactttgcgggggtctgagagagtatctgaatagccttttaaagacttaaaaaggcattggcttaggaattgcaccttgcatggctaggtcattgtcctcgaggatacagcatatttgttgaaccagtgatcactatatgcaatcactgtgctgttttcccagcatttggaatacacaggaatgataattaaaggatacaagtaggactgacttaaacacactccctttcacccattagtggaaattatgtttttaattcttacaactttaggctcttcctgattaaaagccttggtctcaaggtgtgtgtacagacggagacagtaagtgttccactgcatcaatgcagtgccatctgaggatttgggcatctccatactgacaggtcagcaggcaaaaatgggagtactatactggcagggacacctgactgattatcttgaagagtcggagttgctgctacataatgggcccagggaggaagatgtctagaacttgggggaatcactcaggccccccttagtgcttctttgtctggcgataatagcagagaagcaattgaagtagccatgtcctcacaagggcaaggtaatcaaggcccagccactcagagatgaaggtctggtcatacactgagcaagcaatgatgactagtggaagtgctagccaaggattcgggaaatctagaagaagtggaattggagagagatgatgagtatagattatagccttgggaccagctgcagcagtgaagattgtgacttgttccacatattcttctattttcagtcatttttggagattgcagccagctacaactctgaaatgtcagtaacagagcaaactaagggtgggcatgagaggatctgctgagagcaaggaatgaacatggtagtcactaatgatacactgcccatgttccccggctcacctgttagctccccggcagcttgcaaacatgtctatacacactgccatcttcctaccacgagtgccataactctctgcttctctgctgaggcccttctcagctcacagtgcgagtagcctgcaagtgctaagggcataatgcctccaaggtcaactttaatcaacgaggttcaagagtcagaagagtgaattccttctgagatacattctttctggtttctcagaggctccccagaggaagtaggccccagttgcttaggaaaaatggaacctacttattaaggcaccccctttttacttttctcctttctttctctccctttccccactccattccgtgaagttcctgggatcaccaaataaactatctgtaatcaaa

SEQ ID NO: 654 - DNA, 1273 bp, Homo sapiens
ctttcacagaaagaaagtaacagacataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaa

SEQ ID NO: 655 - DNA, 1168 bp, Homo sapiens
tttcccaggttttatcctaggatttttatagctttaggtaataatttgagattttaatccattttagtttatttctttatagggtgagagatatgggtccagtttcattcttctgcatatgccaatccaattccagcaacatttgtcttacatgcttccacagagttttctgtgagatatttagctatgtgaaaaagacaaagttcacactgagactaattttctcacatttatactatttaattctgtttgtgtcaccatctgaatgctatttgagacctaagtcacctgacacctgctaactgataccattttctttccccacttatgttttcattaagtgaaataacatagatactttaaaaatagaatgagcacaacttattgtagactaaaatcagataaatgtcacaaatcagtatatttaatcttaaactcctgtccccaaagtacaagatgtttacaacagattttatttctttacgattgctttgactgtgtatgggtataatattaatgtcttatttctagttatgttgttgttgatgatgattcttatggggtatgtcgacagggcaccacttaatctagaaaaaaatgaggggtggaggatataacactggaaatcatcaggctaagttaggagaaacacatgaataaaagccatcaaattcatgaaatgtagagagttcatgaagacctaatgaaaaatgtacatacatgaagaaggagaaattacataatttatatgtttgcaaacactgctttaagatgagagaaactcaggaggagcttaaacaaagtgtaggttctttttaaggagggaatgctctagaaatggggctttcaggtgcaactgtgaaacacacttgcaaataaagtaaacacattgtgaccctagagacagtattagggaggagactgagggtctaaacaaattattgtagcttgggtataaaaatagttcttgaagtctgcaagcaccagagtgcttccgagtactaatgaattcttcagtcactgactacagtcaattcagcaaagttgcatattcaagtaatcttgaatgttctgggactgctatttctgatcatggtctcagaaaagcatagctctctcctctggtactcagtgtaacttggtcttggagctgagcaatccaacagcc

SEQ ID NO: 656 - DNA, 2556 bp, Homo sapiens
ggggccgggctgaaccatggcgggcggcggcatgggggcggtggggctccgcgggcagcctggttgcgctgcacccggacggggccgaggggacctgaaagctgcggcagagcctgaccgcgccgttctccagaagagccccggccgcggctgagtcgcgctccgggtgtggacggagccggagcctccccggggctcggtgaggacacagggcccaagccccggaccttcaagtcttgaccgagcgcatccccggcccttctgcgcccacacctgagtttttgtctgtaggagtttccgcagtttgctaagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataaccctttagtacatgtgggaaaacgttgacattcatgttcaagtttatttttctgctggctcatttaggtttgttgaagccttgagtccctaggattgtctaagaacatgggtaaatgtgtgtggaggcctccctggaggccagagaactgccagcagccttcatgatgttaggggaacaggaacctaggagagccagggtgacatcgttttaaaatcaacaacccatcttggcgggcgcggtggctcaagcctgtaatcccagcagtttgggagaaaaaaattagccgggtgtggtggtgggcacctgtaatctcagctactcaggaggctgaagcagaattgcttgaacccaggaggcagaggttgcagtgagctgagatcacgccatggcactctagcctgggcaacaagaatgaaactctgtctcaaaaaaataaaaataaaataaaataaactccatcttaaaaccagtgaaaccaccattgcaaaattataactgagacagtgagagatctgacctaaccaactccatcctacttttaacctccaaactgtccttgttcattcctgggtgtaggccaaactaactttggaagaaacttagtttatggtttcccgaaacaaatccttttcttgtctggagactagactgcctttgtaggactaactgaatattctagatacttgtgaaaggatattgtggaggaggagctgggggtagtaagtatgatggaaggcagacgagttttggaatcttgtctccaaaacactctcatctgttagaatgactcctaggctataggattgactatggcttagagtggattcatagttgttaatttcatcatgtgacttgtgacttatccttttcttttcataatagaatgaaaattgccatctgtctggcttcttccccatctttttgccttctttcattacaccacacacgtgtcctaattattccaaaggtgatacatttgcctcactcctcagtatacacacctcttttagggatttctgggcttcttgactagctcaagctcttcagaggcatgcactttatcttggtgttcagtcttgactagtttaaacttttgatgtccagaaggttttcttcatgtgttgttgtgtggaattgtaaatattttctagcttttgtaaggttgtggctcatatttatatttctcctggtttgaaagaagagagagaaagaagtatgtcaaattgagactcttagattggaaatctgaatttatttacacgattgagattgatctagagttttattttttctgctgtaactgaaatttggattcaagattatatgtgttttgtgaatatgtttggtaacattgtgacttttctataatttagggaagtttgatgtaggagaaagagaaaaaatttttgagagaatcctaaattcatatatggcctaaccttttaatatctatgtaattttagataataaataatttgtttgagattatgtggctctaacaacacctgcttcacagtgtaattatgaggatttcatagaatttgtatagtgagcgttagttttgatgttactttaaacctctttgccttatacattctgttttttccatggaatattatatgatttcatgtccacatattaatctcatactttcaattacattttatgtttaaattgaatattatggtaatcgttatgtaaatgattaaaaatttaaagggacaacatttaatgttgctctggaattcacctttagtcataaaataaagatttaaagtatcatctgtagacaatggcaaaaggccttttttgtcataagaaaatcaaatatgctttatttcacccaattaacagtttctgggcttggccatcccgggaaaaccaaaatgaccataggcggtaattccccaggccgtgtgatctcagtctggcattctcagatctc

SEQ ID NO: 657 - DNA, 1843 bp, Homo sapiens
tcatgctgttctcacgatagtgaataagtctcacaagatctgaaggttatataaagagaagttccctacaccacttctgtctttgcctgctgccatccacgtgatatgtgacttgctgctccttgccttctgccataattgtgaggcctcctcagccacacggaaatgtgagtccattaaaacctctttatcttctcagtcttgggtatgtctttattagcagtgataaaacggactaatacaataaattggtattggtagagtggggcactgttgtagatacccgaaaatgtggaagcaactttggaactgggtagcaggcaggggttggaacagtttggaggcctcagaagaagacaggaaaatgtgggaaattttggaacttcctagagacttgtttggctttgactaaaatgctggtaatgatatggacaatgaaatccaggctgaggtggtctcagatggagataaggaacttgttgggaactagagtaaaggtgatgcttgctatgttttagagactggtagcattttgcccctgccctagagatttgtggaactttgaacttgagggagataatttagggtatttggcagcagaaattcctgagcagcaaagcattcaagaggtgacttgggtgctgtttagagcatttagttttaaaagggaaacagtataaaagtttggaaaacttgcagcctgacgagcttataggcataagagacttgccttgtctcagatgaaactttggactgtggacttttgagttaatgctgatattaggtaagagtgtggggagtgttgggaaggcatgcttggttttgtccaagtctccttgaacagtgcttgcctgatatttttgggaatataaatccctgggtctcttataaaaaggtaggtttaaatttaactggtcagggatggggctgagaggctgcatttccaccccaggtgatgctgatgctgttggctcccagacaccactttgggtaacaagctcctacatcagaggtcaacgaactacggcaatagaatatggtagaagggaatgtgtgtcagccccaaatctggcctcaagaggcttaggcttacctgcttctgctttttccctcaggactctgcttaccctttgtgaataagcccagtgaatctgctgagtgatgagagagagagtgggccagtcacttcattgctccaggtaacatgcagttatcttcccccaggtaggtcccagaagacctgccaactgactggacatgcgtaagtgagcccagctgggttacctgagtctggcccaggtcagcagtgctagccaatggacaaacaacatcatgagcaaaaattaatgtattatatgccactgaggttttttggctgtttgttgtggtacattattatagcattagataatgatgcaaagtgcagaacagctttatttggcaggaagagtaggggatgtgtgctcactttccatttctaatcaatcaccaggtcttactcatcctatatcctggatgaatatctctaattcattcccttctcatcactgtccctgccactcacctaacctggttatcttcaccacttgaaacttctcatgctgtcgtatacaactgtgtacttccctcccaagcatcattataatttgctccagttttgaaagattctgaagccagttttgttgagagaggagggcaacagatgaacaatattgggcatctactttattctatgcacttaattaagcttattgataaggctaatcacagacttaaccataatcataataaattggcaaacaatgtttattgagcacttcttacgtgccaggtccttagttca

SEQ ID NO: 658 - DNA, 2876 bp, Homo sapiens
agagggtgagggtcccacatctcctgcaggacaggccctagctactgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaaggtatatttgtaagccgagttgaatgctttgtggagagagatcccattcaggagggctaagcttgaatccaggacttactgaggagcaatcacacagaaaaggacagacacttcgagggaagtacctcagaatgagagccttgcattcatttactttggctcagtagctcctactcctatagcatttgggaaggaagaatgattgcctccatcccatgtaacacagctcatattatacagaaggagaatgcaaacttccttctctcaagcctctaaaggtggaagcaaacctaccttacaaacagcaggcttgctcctaatcagtgccgtgaagggaccaatgctgcctggtacatggagtcagtaggaggatgggcagatggccactagcatcagtgacaatgcagcctggagtggattcaacagacaacacagacttcccttcactctcatctctgcccccaccagaggcactgagtcactggcttaactgagtcactgaacctggaagggaccacgtcctccttcattcactcattatctcagtcagcatatacctctatgtgtcaggcactgtcatggccgctgctccagcaatagataggacagggcccctgccctcaaggagcttccagtccagtcagggctaccccttcaatgccacccccctgctggagagcctggatcttgggtaaggttccacatctgttactgctgtaacctggtgatgtcacttactcctctgtgtcttggtttctttatctgatatgaaagtctcatgacttgctgaataaatgtcataacatttcatttaactcagtttataatgttgcactagtcatcagattcactgagttcttcaaaaatatagctctttggcaaaattcattgttaaaaaataaataagccattgtaagcaatttttataaatttagtttgtttttattcattctaaaccatgggatgccctttggacataatacaataatgattctagggttcttagaaacatgctatttgtttccttccttatccctctggatgtgaagtaaaataataacttaaataacttgaagtaaattatactttaaaaagaatctcagccaggcacagtggctcacaactgtaatcccagcactttgggaaatcaaggtgggcagattacctgagattaggagtttgagaccagcctggccaacatggtgaaaccctgtctctacaaaaatacaaaaattagccaggcatgctggtgtgtgcatataatcccagctgctctggaaactgaggcacaagaatcacttgaacctgggaggtggaggttgcagtgagcagagattgagctacttcactccactctagactagtcaacagagtgagactccatctaaaagaagaagaagaagaagaatctcagatttataagatgagagattcagaaatatttggtttccaagatctaggcatatttggtttcagcacccaaaactttggacagcagcctcctcattctctcctggtagaactgacttgagagaaagcctggttagggctaactgattcttaacatctctctttaaccaaggtcatctcaattctaggaaggagagtgtgcccctggctcagataaaccagtgagagttgaagggtaccaaggacaaggtactcagatgacaaggctaaggggaaagctgcactgtgggcagcaggaagtaactggacccacatcagagctaacagcaaatattcacaccataactccgaattctcagatcccaggtagactctgacttcctcagaatcccactgtgatgtctgagcctcagagcaaggcttggatgccacagtgggctctcctgcttagttgtagtttgagtcactcctttgctcttttgcaccatttcagctaaatcctgtgcatggggtgtgggggtttctttagaccttgagccgaagctagaaaccagatttcaaaaaattctgtgagcagcattgagaagctataccagggagaagcaaggaccaggcttttcagtcaagcataactgagctattaagacacaagagactcaggcgtctgcctgtccgcatcaatctaaggaaaactcagcacacattgctgcagcaagcagaggtttggacatgggatgggctgttatactgtgcataatttaaccaacacatgtcggtggctgaatgctacaaaatccacttcttgctcaagtcttacatgaccagtagggggtcagcagggggctcttctccacatgtctttcaaggaccctgatggaggctgatggaggttctaccacagcatggctgcaccgtctggaatccatggccttctgggtcacctggcagggaaaggaggagatgaggagcctttggactggcaattaaatgctgcagcctagaagggacacactcatttcctttcacaatctattaatcagaaatagtcaaaagtgatggtccccaaaaaaaaggaagagctggctgtggctgagcactagaagattctgccacagtccctgctatggatgagtcctcctccccttctgagaccactcgtttcttcctgcatatttactgtacaaaaatattataacaatacaaggaataaaaatggaaaggaagccctccgcaattccatcactctaacaaatc

SEQ ID NO: 659 - DNA, 2878 bp, Homo sapiens
agagggtgagggtcccacatctcctgcaggacaggccctagctactgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaaggtatatttgtaagccgagttgaatgctttgtggagagagatcccattcaggagggctaagcttgaatccaggacttactgaggagcaatcacacagaaaaggacagacacttcgagggaagtacctcagaatgagagccttgcattcatttactttggctcagtagctcctactcctatagcatttgggaaggaagaatgattgcctccatcccatgtaacacagctcatattatacagaaggagaatgcaaacttccttctctcaagcctctaaaggtggaagcaaacctaccttacaaacagcaggcttgctcctaatcagtgccgtgaagggaccaatgctgcctggtacatggagtcagtaggaggatgggcagatggccactagcatcagtgacaatgcagcctggagtggattcaacagacaacacagacttcccttcactctcatctctgcccccaccagaggcactgagtcactggcttaactgagtcactgaacctggaagggaccacgtcctccttcattcactcattatctcagtcagcatatacctctatgtgtcaggcactgtcatggccgctgctccagcaatagataggacagggcccctgccctcaaggagcttccagtccagtcagggctaccccttcaatgccacccccctgctggagagcctggatcttgggtaaggttccacatctgttactgctgtaacctggtgatgtcacttactcctctgtgtcttggtttctttatctgatatgaaagtctcatgacttgctgaataaatgtcataacatttcatttaactcagtttataatgttgcactagtcatcagattcactgagttcttcaaaaatatagctctttggcaaaattcattgttaaaaaataaataagccattgtaagcaatttttataaatttagtttgtttttattcattctaaaccatgggatgccctttggacataatacaataatgattctagggttcttagaaacatgctatttgtttccttccttatccctctggatgtgaagtaaaataataacttaaataacttgaagtaaattatactttaaaaagaatctcagccaggcacagtggctcacaactgtaatcccagcactttgggaaatcaaggtgggcagattacctgagattaggagtttgagaccagcctggccaacatggtgaaaccctgtctctacaaaaatacaaaaattagccaggcatgctggtgtgtgcatataatcccagctgctctggaaactgaggcacaagaatcacttgaacctgggaggtggaggttgcagtgagcagagattgagctacttcactccactctagactagtcaacagagtgagactccatctaaaagaagaagaagaagaagaatctcagatttataagatgagagattcagaaatatttggtttccaagatctaggcatatttggtttcagcacccaaaactttggacagcagcctcctcattctctcctggtagaactgacttgagagaaagcctggttagggctaactgattcttaacatctctctttaaccaaggtcatctcaattctaggaaggagagtgtgcccctggctcagataaaccagtgagagttgaagggtaccaaggacaaggtactcagatgacaaggctaaggggaaagctgcactgtgggcagcaggaagtaactggacccacatcagagctaacagcaaatattcacaccataactccgaattctcagatcccaggtagactctgacttcctcagaatcccactgtgatgtctgagcctcagagcaaggcttggatgccacagtgggctctcctgcttagttgtagtttgagtcactcctttgctcttttgcaccatttcagctaaatcctgtgcatggggtgtgggggtttctttagaccttgagccgaagctagaaaccagatttcaaaaaattctgtgagcagcattgagaagctataccagggagaagcaaggaccaggcttttcagtcaagcataactgagctattaagacacaagagactcaggcgtctgcctgtccgcatcaatctaaggaaaactcagcacacattgctgcagcaagcagaggtttggacatgggatgggctgttatactgtgcataatttaaccaacacatgtcggtggctgaatgctacaaaatccacttcttgctcaagtcttacatgaccagtagggggtcagcagggggctcttctccacatgtctttcaaggaccctgatggaggctgatggaggttctaccacagcatggctgcaccgtctggaatccatggccttctgggtcacctggcagggaaaggaggagatgaggagcctttggactggcaattaaatgctgcagcctagaagggacacactcatttcctttcacaatctattaatcagaaatagtcaaaagtgatggtccccaaaaaaaaggaagagctggctgtggctgagcactagaagattctgccacagtccctgctatggatgagtcctcctccccttctgagaccactcgtttcttcctgcatatttactgtacaaaaatattataacaatacaaggaataaaaatggaaaggaagccctccgcaattccatcactctaacaaatcaa

SEQ ID NO: 660 - DNA, 2520 bp, Homo sapiens
gtgctcgagcgtgcgctggcggcggcccgggctcccgggcgtctctcacgctgtgttttggcggcgcctggggtcttcgtttgcatatgagaagagccgaaagcacagagctacaggcgaatacaagtggattttttttctttttctgtttttttattagaagtaatagttgctgcattttgaaaaatcaagaggaaaagagttaacaggaagaaaagttcgaggctggaatgcagtggtgcaaacatggctcactacagcctcaacctcctggcctcaagcgatcctcctgcctccacttcctgagtaactttggtcacagagacacggtttccctatgttgcccaggctggtcttgaactcctggtctcaagtgatcctcctgccttggcaaaatgctgggattacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagggtcacacagctgctaattgttctgtgtggggaacatgtgaggggagaagaaaagacacacatacaatacctgtaagggtaaacaacctttatcccatgtaaatggcaatgcggatataataagcaaatgatataataagcaaattgatataataagcagattgatataataagcaaattgcaatgggaaggggagaaggaaaagatacatacatacatatatatacatgtatatatatgtatacacatatacactcaccagactatggaggattcaccaccagactgggaagcaacagcctgggctccagagtcggacaccacactcaccagattatggaggattcaccaccagactgagaagcaacagtctgggctccagagtcagaagtaacaacaggctgacctccagagtcggacactaactcaccatagtatggaggggattcaccaccagactgggaagcaacagcctgggctccagagttggctacccatccatgcacagatgaggagaggtctcatgaagctttggtattgtccgggaccctagctttttttgtaaaagttgtttggcatgaggcccagtcacagtggcccttcgctgtgtcataaacacttttcatgtaattatttgtggttttatgatcatatttataattacagcaaattttccactttataacacaacaacttgtacatttcactaataggcatacatattgtgtctgtttttttcactagtataactaatgctacagcaaacatctgtgtgcataaatctttgtttaaatatgattattttcttattattagaaataaaatggtgatgagaagataaaagtatttctaaggctcttgaagcaagtggtcacactgtttcctcccacaaattttgccattttattctgaacagaatacctttttcattttttactctgtattatactttttaaatctttgctaactttacagttgaatgatacctcaataatacttgcattttataaagaaattaacatttttttcttcttatagtttctaatccataggtagtttaaactattcattgatattctttttttttgcatttctatgcttcattatttatagaaaatttttaccgttttatatttctttggttttgtgttactcttgattttccatattatgtttttccatatgaatatcttttattgttatgtagttaaccaagttgtgtcttcctttatttttcttttactgttttaagcttggaattatttcccatggagagataaatattagtctacctattttttatacaagtattttgattttttgaattagcagtttaattcattgaaaatttaattttgtctaatatatgaggtgaatatctaaagtttttccacctagcttatatttggttgcaaaatcattgtttacgtttccccattggtttgtattgttgcatttcccacgtgaacacttctgaaccattgttttgtttcatttacttatttgtcttttcctctctcagaaccacactaacttgttattatgactttataccattttgtaatactcggtaacattattaattcctcatcaatctgacttttcaatagttttaaaatttaatcttaaacatcacaatcttaaaaaaaaacccataaattccattggcattttgaccaagagtatattaattgcacagattgctttgggtgaaattaaccactttgtaggctcagtcctcctatttggaaaatgttaattatctccatctatttatgttatcttctgtacttccctttcttcctatattttacacatgtcctgataatgttactccaaagtattttatgatttttttccctactgtaccacactgcatgtttactcatacaaacattataataaaatttcttacttttaaaataacttctattttaaaaata

SEQ ID NO: 661 - DNA, 2864 bp, Homo sapiens
gtaagaccacctcatgagtagagctgtgttcttccatcagtcaggttgcttctctgtttgtgatgtttgcagccattgatgatcactgcctagatccattaattcattaaggtctgcaaaaggaccctctcttctccactctgtctcccaggtaggaacctctgaagctgaggacgtattcttgctggcttcattattgtcatcattcctcttcgtgacctattacacatttctgaagagaaactcctctcaccagctcctttgtttcctaagatggctgggatcctgatacctacatgcatgagaagccacaccagaatgccagccgacatttgcatgcagagacgttgcctgtggagctgtctccagaagaggatgcagctgcaggtacttgaggaccacactccccctcccaagcctaatgttccctacatggcagcgcactgagcattggcaatgcaaaaaccacttctcaattactcataattgagttgcaaaaagagattattctttgctgaaacttgacttctcatcctggaagcaggtttttctcatttgggatgggaggggggcaaattatattaaaatttgctggaaatttttgcttggaacaaggcacaaaaatattccttggaggttgcagatgcctcagttgtcattctttaacaaaatcagggctctctttgtaaaaacaaacacgacccaggcatgttcactctttctttggaatgtatccatggtgctaaattagattttttgaataccctcacaactggccccaaggttgtgcatggctattgctgactctacaacaggggaattaaaggctaaatgtattctgctgactccctggttctctgcttatccaaagggcactgggattcattttggaaaatcctagagattacacacaggctttcttccagggataagttaaagaatttaggaaacacccaggcttctgtcttaacacacttgaaaaaaaaaacaaaacatatcttataaggtgtcccagtgacccaaaataggtaaaacacctcccaaggaagcacttttctgtaaaatctggttctttaacccctgtgcctcttctcattctcaaaactgcacaagaagcagcatgcccaaggttctagcccaaattgacattgcattaacactgtcaaaacattaatggaaagtgtcccaggaaggactagagagatttcttctaccccattgttgctgactctgacttcctggttccatcaagattccaaaggggaggagaaacttgatgcttacctcggggaaatctctgagtataaaaccttaactgaacctaccgagatcaggaagagctcatgttcaaaagctgtcacccctctcccggacagacaggcttgcagggagccccagctctgtccacaggagccttggcctgtgacctgactctaggcttgggaccccctctccaagaggtagggagggcagacctcccaaagcacagggtttcatccagggctctttataatttctaaggctgccctctaaaacctactcctttgcttccctttatcttcccctccatcaattcccttccctcctatttccaaaaaccataaccataaccaaatttggcctgattctttaaccgataaacctaaaaattcagaaatcaggcagctctaacattcttgaattgtgcctcatgatactttagttgttgctgttgtcattttgtttgtcagaagaatactttgctatgtaggtgaatttaaaaagtgaccctggaccattatatttcattataaaatacagcggcataaggccctctccaaaagacatgctacagctcctgccttgttgatgtaaccatataaacctgtgaggagcatgagcacacatccaaatagacatatctcacatgaacacgctaaacagagacatggcgcagaagctatgtggggccttgggctgaaccagcagttagagcatgcaaaataccactacagacaaactacagacaagttctagaaagtccagttgatactacatgagcaagccagtgaaaagaaataattgcctgtagcaacacaggatacaaaatatatttttagaacagggtcttaaaagtgttaggacattaaggattctaaggaaatctggtctgtatcagtgaaaataattttgaaaaccgaggaaaatgctaaagtccaatgtaaaggaaagggtggaaggggcaagtaattgacaggtttcctggtggccgcgcacctgcggagcacttactcacctcactcacctcactcagtgcttttccaggcatgttttatttcctttgcagtcctcggcaccctccgaatgacccctgataacagcaatggccagcgtttctctgatgctctgctaattccacacgtgacctcatctgagcctcacaatgaccctgtgaggtaaggattattgtctcccattttacagagaaggaaactgagacccaagtggtactcaagtgtcccctggatacctaccagtaagtgataccttactggtaggtatcctaagctcactaccagtaagggacacagcagaagctccaccccacttggtgactctcagtgacaagccctccctacctggccataccacctcatgtggtgtaaagctctgttgccagtatggaaaacactcacacgagtaaaaccaaatatccacttgcattgtccaaaatgacatccagagtcgagaggccaggaaatattcctagacacacataggttgtccattcttcattcagcagtttagagacaaaggcataattaggcccatctgtaaataaagtgagtccctgacacaggacacaaataaagggcttcactgtc

SEQ ID NO: 662 - DNA, 2240 bp, Homo sapiens
attcagaccttgacagttgtaaccgatagactgggctggggcaacgctgatgaaaggcaaattcctgagagaaaaatcacccagattagcattttggtgtggatacagaagacgagattaacacagatcaagtaacatggaaataaaaaaggagacaatgctggatgatacaggggcagccaacaagaggagaaaacccaagcattggcaaatgcctcattatccaaagaacactgggcctcagagtatgtcagctggggtcagacgggaacaggagtctggctcaacacacatttattgcactcctgtttcatgccaagaaatgtaccaaaatctgggactgtgtaacacagcaaaggaaaagactcatctccaggaagcccccttgtctaggaagagaaattgaatatcagcataaggtggtgaaaagctgtgaaggagatgagtgccaggagtccatggaggaaggattctagcctggacaggtgaggaatggctttctggaagaagcagatgccccagctgaactttaaaatgcccatgtgaaatgaactgtctgtatcttcaatcagcaaatggagtaggtggccactgtttaattctggaatggggaagtgtaaaggtgtggtgtgtgtgtttacccctacttagggattcaaaacagacagtaaagaacaaaagtctagccctttgagcattctccatgggacatttgaggtctagctggccccagagaaagagagacagaagcaaggtcatatccatttgagaaaatcaaagtgtctgctccaattgagtctggtgtccttattcctggaatagccatccctactgctctggtgctgatttacctccggcagttcagtgcttcctggaaggtaggctgggctttttaacaaagtgactccttacttgacatgttttacccaaacacagaggccactgcactatgtgcaagaaacaacaaaaaattaaatgagactcaatgccttccttagggatctaaaaccccagtaacacagataaacaggtaaacaaataatgtgatggtgtgattctatagcaacaggaatagagcactgcagggccaccgaaggaaaaggtgatgacctggcttggattcagtgataaaaaggggcttacctcctttctctgtttctgctaaaagccagtgattaccccctgcttttcccatgttgggcatagctgtaagtactttagacatagcggcacatttaatcatcatgcaacaataagaggaagctgaggcagacagaagtgcccaaagtcacatacttgaagccaggacttgaacctgggctatctggctcctgaatccatggctttcactaataatgacttaccctccaatgaggaacaagctccattctggcctttctttagcgaaggcaactgcctgagctcatggtctgatctggcttctgggaaagagaaagcaggggaaacgtctagagatggcatactgggagaagaaatttcttgctgtggaatcctgcccccatctccctccccaccatacacaatcccacgtgcatttacacctacacgccgtgtacacacgaacattttttctgctactcccatgggccccaactctgccttttcatcaaaatcacccagagttttaaataaaatgcagatgttgaggcttgttcctaaattataatcttgggcatctaaattttttgattaaaaaaaattgacatgcatgcttaaagtaaaaatttagacaatacagcaaagaatgtgtttgtacccctcccacctagcccttagttcttccgaaaggcaaatacttaaccgttccttgttatccttccagaaaacaatatatgcatatattcatcttttttttcttcttcctctgtaggtgattgtggtgaatagtcatgagaatctgggaactggctcctgctctgtctatcttggagatgcatcttttgtgagaagccagggcaagaatagggaggcttaggcaatgggaagtttctgagtagataaagcagatggcagagcaaagggacagagcctggcgagaggctactccctgtagcaacctgcctaagagtgagaggaaagcaaggcatggctatgagcacgtgtagtctcagctacttgggaagctgaggctgggggatcacttgagcccaggagttcaagaccagcctaggcaacatagtgagaccatgtctctttaaaaaaaaaaaaaaaaagaaaaa

SEQ ID NO: 663 - DNA, 14676 bp, Homo sapiens
acacaagctatcgctgactgccggtgcatgttggaaatgggccacagggctgggcatgatatgagctgcctggacattggagggggcttccccggaatggagggctccgggcccaagtttgaggaggtgagctggtacgggcgctgggggtgttcagggaggtccgcatgtgtgcccaggcatgggtgtgtgtggggagtctgtgttcatgcatgtacctctgtgtgtttaggtctctctggtgtatctctgtgctctgtgtgcacaggtgggtatgtgtgtatgtgcatgtcttggctttgatatcccccaaaagcagactctgagacaaacacttggatacaagtagtttttttggagatgatccgtggaagcgccaatgaggaagtcaggaaagagagatagaagggagaaaagtcaaaagaaaattcatctatgagctggttaccactgtgggccgctgcaccagtccccctggggacaatgtagaacctcagaatcatcccactagaggacatggggctggtcctttattcaccaactcctgtccttctttggttgaaggctgtggtctgggggtgttaatttcctcacattccagctagtttccgagggtgctggagaaagcccacagaatgagaagcaaagggaggcaggcgctggaggctggaaatcattttgcacgggcagatgagctcaggtaggctgaggggaggtggcacagggtgtccactgcagctgcagcaaggtgtctgggggctgtgcctctctgtgtgtctgtgtgtctgtatgtgtatatgttttcctgtagaatgtagaattcttgttagcatcaccaatacagttacagttacagttgggagtttacattccctgggtccacaagacactcgccttcttacggtgcatcagattaaattgctgcacctttggacttctcagggagcctggtggccagcaaccccacacaagtgacctcctgtctctcaacttctgtttcctctttggtaaacagggataattctaatgcctacctgcagggtgcctcggggatgaaaggactgatgcaggtaaggcgttggcacaggcgctggcacatcaacacgtgctggatgagttaacctcttcctgctgtccctccaccccattccagttggcgagagtgatcagtgctgccctggcccaggacctccctgaggagcgtggtgtcaaggtcatcgcagagcctggctgcttctatgtggagtctgtctgcatggccgctgtcaacatcattgccaagagggctgtgctggagcccggtgggtgggccaggatggcactgggtggggatgccactgtccaggtgtccccaggccctggaggagaggaagggcagagggttgggctctgtcccaggagctgggggtcagagtagtgactgagcactccccaggaggcagccggaagctggtgtattatctcaaagatggccactatggctccttccgcctctgctaccgagagcctgtcccaagggttcccatcgtggtgaaggtaagggggccactccagccccgagtctagtcccttaccttgaggtgccttgtgcctcccctactgggaacagtggctgtgctggaccccagaggcaggtcctggcctgctgcttagaacacatgtggacacgtacatgatgtgtgctcacagatcagagcgtgtgcagcagctggatatgtaggcctcctcaggcaaaggggcgatcaccagaacacaaaggcgtgggttgttttccaaaatattgaagttcttctccctggtggcttaagagccattccttcttcctggtggttaaagagctattcccccgagtccaccaggggcctccctgccgacactcttgctgctcagtccctcccacgatctggcaacaaagcttcaatacctgaccctgtagggccaacaggatcttcctccagctctgcagcagttgtctcctaatgtgatgggttggtgtccgggccacactgctttgtaaatatcttgactgtttctcccggccagtgaacgtcttggtgtgtgcacacatttggtcatgtatgtgacgtgtgtttgcatgcatgtgcgagtgtgtacgtgtgtgaagtgtttctgggtgtgtgtcttcgtgtgtgtatttgcctctcttctcatcggaaggagtgagttctggatgtggaggaaccagtaggagaccctgtgtttgtttggttcccacaatagttttcaattttagttgcccatattaaaaaatctagacatatttcataaaagcctggattttctcagctcctctcaaacatttgagagatctgatgatacgtggcctgcagaacaacaaggcaacaaataattcaacaaattagtctagcatgtcaggcactgtgatctgctggaacgggacttcctcagtggctttcccctttggacagacattgactttccagtttgttgtaagacttacctggcccatttcactcatttgtgttacctgcttgacctctaggtaattgagttttcaactgctgccttatagcaattattgaagacaacagccccacttacagaggaggaatctgagcccttacttgtaggcacatcagacctggccaggctgggcaggggccatggagggatgggtcccagccagtatacacccgtgtgcccctgggagtgtccttccgggtctttcagtgccttccagataagggggtgggataggccagcctgctgtcttttctgaccccctttcctatgtcacacaggagttctgctcagagccgcccctcttcccctgcaccctctatgtcccatgtgcgatgcctttgacaggctcttcttggaggatgtgcggctgcccgagctggatgtaggcgattggctggtcttcccctccatgggtgcctacatgtcctccatgagctccagcttcaatggcttcctgcctgccaccatctgctacaccatgggcccccagctcaggtgcctaggggttggggttgaagaggaagcaggaaacctcacactcatttgagcttggggtgggaactggccccagggaatctcccttcccctgttgactcactgaagtcaaagtgtccatctgacctttggactctcatctgcctctggcccccctcccagggaggtggagaattgcaaagagatccccaggccctctagccactggctggccctactcctgcttcagacgcccactgtcccagctctgcctccaggccccagctctgctgctgtgtgtgcagcctcagggctgtaggcaaaggccttgacacccaccctgtaccccatgtcctttccccatgagccttctggaggcagagccttaacccagagccagctaggctggagggctttaagacactctggtaggtaggcccctgggaactgttgggagttgggatggcagggaggaggcagaggtttgggtaactatgaaatcctatgcagaccttccaaaaatatcttgctgtcattttgggtcagttctttccttttctcttttcatttcttttcttttcttttttcttttctttctttcattttcctttcctttccattcctttccttttttctttctcttctttctttcctccctcccttcctccattccctttctctttctttcctctctttttgagacagagtcttactctgtcgcccaggctggagtgctgtggcatgatctcgggtcactacagcctcgacccctcagggctcaggtgatcctcccacctcagcctcctgaatagctgggactataggtgtgtaccaccacacccggctaatttttatatttttggtagagatggagttttgccatgttgcccaggctggtctcgaacttctgggctcaagcaatccgcctgcctcaacctcccaaagtgccggcattacaggtgtgagccaccgcatgcctgtgtcttcggtcaggtcttacactgacttttctcagcagtggcctgccctgcccaccctccttgtcatttgcctctgcatccctcctttcccactctcttgagcagtggttgaaggggacgcattagaagctacttcttctcagagcgactacaaaaaatgggctattgatcttttacgttaaataatgcagcccacacacctgctcagttcatacctagctggtgtcagtttacatccttaaattcatcctgccgctcctccccgctttttatttattcatgcccttgccttgtcccagaaagcgtttctataaaattcatcaacatatcatagtggttaagagcatgtcactggaataaggaagaactgggctcaaatttaggcaccactgctactagctttgaatttgggcaggttaactaacatagttgaactctagttttccttgtaaaatagtggtaataataataactttaacttccccgtagggttgttgggattaagagagggatgaatatatcgtttagggccagcttttccttcggccaccctgttcttgctggctctcctcctggagtctagatgtcacagagaccccaccgtgcatcctgggtcttttcagagagtgttggtagggtgtcccactcaggccaagccaggatgtgtgcccgatgctagggggacaggggaggcaggcacagacccagtctttgagttgtcctcaggcctgtggaaagctaaaggcaggcgcagctggctgcagcacagggaggaacatgggacatactttgaggacagttcaggtggaagccatccatttggaggagtgggtggcttcttggagggagaatggtgggacctggaggcagagcagaatcagtaggtaaaagtgggtaggaagcgtggctcaggtgtgggaacaacttggctcaggcatgggaatgagcctctgctcagagaacagtgagtggccaggattggagatgagaaacagagattgcagagcctggggacacaaggtgaccagtttgcctggatttgtctggaacattcctggtgctagcactgtaaatcctgagtcctaggaagctcctgagtctcaggcaaaccagatggttggggagggagaggagggaggggaggagctcgtcacaccccaaggccacattcctgcagctatagcaggtacagccattgatttctcagcttccagctcagccaaggaaggtgtctcccctcccttcagcagggcctctcccaccctctctgctaccactcaactcagccaggtcctcggggatcccagagtccctggagctgaagaggaacttcccctgacatgtgggaagcaaagagcagattggggtaacagaggccactcagagaagctagaggagctcaacagcccatccagtcaggtgcatctcatgagggcatcccagaacatcaaatttcccgcctgcaaaatggtcttgcttatgcccaaacactcagaatataagaagcacggattatgggtacgatacttaggggtgtgagcaggctttgggaaatgtgaactctttccagatggaagacattccagtgagttttctttgcccctggggggtgggagagggtgagtgggtctgagtatgtaagtcacaggtctccaggtctaaccaaccagtggcggggtgagtagtttggtgggaaggacagttaggaacaggtaactaaaggtgagttaggtcagagcaggtgaccaggggtgattcaggtcaaagcaggtgactgggatgagtcaggatgcagagcaggtaaccaggggaacagatgtgaactgctgattaaaactggggggaaatgttgtttactgaaactacggggaagttaaactttaaaatggaggacaaagaactgaacatattgacatattgattctttgaagagaaattttgaactcattgtatccaacaggaggatcacgtgagcccagcagtttaaggccagcctaggcaacatagaaagactctgtcttatttttaaaaataaaataaaataaaaatgacagaaatgtattctctcatagttttggaggttagaagtctgaagccaagggttggcaaggtcactctccctctgaaggctccagggaagaatatttctttgcctcttgcatcttccagtagccccaggccttttctggcttccggcagcataactctagtctctgcctcacaacgtttttctctttgtctctgcgacctcttgtcttcttataaggacaccagtcatccagtggacacaaattttgtgggggcatgatttaacttcaacctccaaccccctgccgcaggtcaccctttggcccttatggcctccaagtcttgcggctggagctcacttctcagcctggggtcatctgtgtctactttccatagcaccaggattcacctctgctggtggttcccaggttctctctccagctgtgacctctctcccacactccagacctgaaaatctcacagcctcttgatcaccgacccaaggatgtaccacagttcactcagattcaacacaagccaaagggagcccgctatgggcccccatctagcggaagggctgcttcccttagccagagtgtacctcactcctcagctagaaatctgggctttgtcctccattttgaacttctccatcacctccctcatcaatgggccaccaagtcattcacactggaggtggtagagaaagccaactgtgtgccaacagcttttttttttttttttgaaatccttcctgttctacccccagaatgtctcatgcacacagcccctcccttcttccctctctcccaggtcactgtcaggttccagcccctcactagttctctccagagccagcataacagcctggtggcctccctgctgtggtctcattttctctaatccattgaccacatgaccccacaagctccttcttttttcttttttttggagacagtctcgctctatcccctaggctggagtgcaatggcatgatcttggctcactgcaacctctgcctcctgggttcaagtgattctcatgcctcagcctcctgagtagcaaggactataggcatgcgctaccatgcctggctaatttttgtatttttagtagagacggggtttcaccatgttagccaggctagtctcgaactcctgacctcaggtgatccacctgccttggcctcccaaagtgctgggattacaggcatttgccaccacacttggccaccacagagtcccttccaatgtgctctcctgagcctgatgcccactgtgtaatcccatttgcggcagcccatatatgcaggataaagtccaagctccctagtgttatgggatctttggggtgtcaattttttggctggaaacatctgtggccacagcacctttgcccaagttcttgtcctgtgtccaggaagaatgaggtatgcagacaagcaaagagcgaacaagatgaagaagagttttatttagtgttacaacagctcagagactggcagtgtgtagctcctctctgcaggcaggtcatctgtccagtgttcagttctcagcagagaggaggcctcggagagggtggctcctccctgccagcaggttgtctctgtagctctcagtggagaaggtagctcctctctgctgctagtcatcccatcatctccagctatcagcagagagtactcctctctgcagctggttgtgccattgtctctctgctctcctcatcctctggccatcctctgatctgctctggctgagcctagggcttttatggaccttttatcagggaggaagtccatgccaattggtccacgggcagccatgggtgggctggaagaggcaccatgagtccccactccagtccatgggactggcagcctggcccgcagccttcaggccttccctgacctgaaagtggggtcttactggggacctgcccccttctgcccaggactctgtctgcctcccgctgccattcaaggccccagggcttggccccaaccccgctctgagatgggagcaggtgccaggagcagatagaggccaggcagcgggagcagacacccctgagcctgcaggccaccactgggcccttcgtcccaccagcagagggagagctgaccttcttctcttacattctcagcacctgtgaggtggaaggggatgcttttatgatcacttcctgaaagagaggctcacagaactgaactgatgtgcttgtcatcacacagtggaggactgtctaacaccaagtctctcattcccttggtggccagcccctctcagacctcagcaagtccctctgggccttcatgggagagcagtgtccaaggaatgcggtgtcacgcttgcggctctgccaagggcttcttcttcgggctctgcctctagctgcttctgacagaggcggattcatcatgaagcaaacgcggctgaaccccccagtggtcttcattcttctccaacccctttcaagacccagggatgggctcagcaattctgttttaataattttgcattctgtcccttaaatcataaagagagcccccaatctgtaaagcttctgatcccacacaacctctcagggctccagggtcctgaggaggatggccaggtcactgtgggcctgtggtggagccagcgggcacccagggcttcctggtgggccaggtccctggtcatagactgagccagccagcatcagcctccgatctccaggcccctgcggtgagggccccaatgcccctgataaggctctgctcctaaagggctgttggccttgaacaagctgctctcctgcctcagtttccacttcaggatggagacatgaatgagagaagtgtccctgaaactcctgatggctttccatttcctggtttcctgtctttcctgaggctgaattcttcgcctgctttctctgagatccctcactttcctgccaagaaatttcctctttagtctgttcagagtgaagtgcaaatcaaaataaaaaagtgcaagttcaaagtgcaatcaaaacaaacaaacaaactttggctaaggcaaaaccaaaccaaaacaaaacaacccaactatctcttttagtagagttttgacgctgcagcatgtgttgaatagagcccatgtgagttaggctgcccagggcctgagtgacattgcgtactgtggggagtgtgtgcttttgttcaagcggtggctctcaggaagccaggaggagatttggacaaaagttggaaaggttggaagaatatgtaagcttggactgacatggctgattgggtttgggccagtttgagctggttttatctggttggatccaatacagtacggactcgggaggccaaggaaggtcttggcaagtttggaccagtttttgccatttgagctgacttgggctggcttgagctggttgctcatcacagtggcaaaaaagaagaacccttgggcaggggtgttcagggtcaggagtggaggaagggaagctatgctcattgttcgtggcacttggtagagctgtgcatctttacaaaagcaatttacagtacaggcacccctcattttcttgcacttgctttgttgcacctgcagatatttgttgtgtttttgttttgttttgttttgttttacaaattgaatattttggcaaaagtttgtggcaaccccttgttgagcaagtgtactgacacctttttccctaaagcatgtgctcactttgtgtctctgtgtcatgttttggtaatttttacaatatttcaaactcactcttttctttctttttttctgtctctctttctttcttttccttccttccttcctcctttctcctttcctttcctttcctttcctttcctttcctttcctttccctttcgggtctagctttgttacccaggctgcagtatggtgatgcaatcttggctcaccccaacctctgcccaggttcaactgattctcgtgtctttgcctcccaagtagctgggacaacaggtgcaaggcaccacgcccaggtaattttttttttttttttgtatttttattagagatggggtttcgccatgttggccaggctggtctcgaactcctgacctcaagcgatctgcccatttcagtctcccaaagtgctgggattacaggtgtgcgccaccacacccagcccaaactttttcatttctactgtatctgttatggtgatctgtgatcactcatgtttgatgtttctattgtaattgttttggggtgccacaaattgcacccatataagacagagaacttaagaaatattgcatgtgttctaactactacatcaatcagtggttcctctactcctctctccttctcctcaggcctctcaattccctgagacccaacaatattaaaattaggccaatgaataaccctaaaatggtctctacatgtttaagtgaaaatgtcacacatcccttgctctaaatcaaaagctagaaatattaaacttagtgaggtaagtgtattgaaagccaaaataggccgaaaggtaggcctcttatacctaacagcgtagttgtgactgcaaaggaaaagttatcctcagcctttcatgtgtattggcttattcagtcctcataacaaccctaccaagtagcatgtgttagcctcaccatttggcagaggaaaatggaagcacagaaaggtcaagtacttgcccagatcagcagcagaacaggctcaaaggttggcagtctggttgcagagtccatgaacttcactaccacactccacagcagttgtgagaccatgggcaagccatctaaacttttgaactttaatatcttcatccataaaatggggacgataataccctgccccattgcccagtgagtgtgtacacccttaactcggtgcataggcttgggttggcttgatccggtctcattcatttctccccacctgaccctacacttgagtcagagtatctcatgttggctgagcttgaagtatgcaggagcacaccccagaaaggccagggcacaagccctgcttggggtggagcagggagggcctgctctgccccactggggtgttcttaggtggaagtgggtgtgggatggtccctctgggagaactctctccctccagcctccctgcagagtcacccagggaactgaatcacagcacaagtgaaatgggaaaagttcccttatccccctcgcagggcctgcaatgggggtgtggctcgcttctttggtaccctgctgctcaaacctctagggggagcatgcagatgggcaggttgtggggcttcaaccccacggcagtgtctaggggtgaatgcttacagttcctgaagccccaatgggtgtgtgttacagagcgctcttttagttttgctatctgtaggcagcttgtgttaatcagctcgattagatcctctgccttatcacaaggacagagggctttctgtatcccagggtttttgccttggtgtactggaggaatcagatcacacgtgggcttagggaccgagtgcaagtttttattgagtggaagtagctctcagcagatgggggagccagaagggagatggagtgggaaggtgaactatcaagataaaatcagtctactactccataacagaggtaaggaagagtatgcatggaatacaggacatcctttagagcatctcttagtattaccatgccctttgattaaggtcaatgggaaactacaatagcgcaatccaggcaggactacaaatagcccagacccctcaggaatgaaggtttgggtcactccaccaggaaaaaaaccacaacctgctgaggtgcttgctgaaggcaaagggaatacagaatgggtagtagaagaaggtaatcatcaataccacctatgaccatgtgaccagctgcagaaatgcggactgtaactatcatgagtatttcctccttctttggctaaaaacatgtttgtgcatgtatacacttgtacgaagaaaatatatccattttatttccttttcctttatcatgtgacataagatttactgacttcatatcaacatttaagtattattaactttatgtaataatatttgggttggggattggtgggtttccagttgtaccaaggatagttgtattattttaggcataattatgaccttattattgtctttatttgaagattatgtatgatctcaggagatgtgtatgggttcagcttgacaaggggtggacttaccatggttaatactgagtgtcaacttgattggattaaagatgcaaagtattgatcctgggtgtgtctgtgagggtgttgccaaagaagattaacatttgggtcagcgggctggagaaggcagacccacccttaatctggtgggcaccatctaatcagctgccagcgaatatacagcaggaagaaaaaggtgaaaaggcaagactggcctagcctcccagcctacatctttctcccatgctggatgcttcctgcccttgaacatcagactccaagttcttcagttttgagacttggactggctctccttgctcctcaagcttgcagacagcctattgtgggaccttgtgatcatgttttagcacctcttacgaatgagtgtctgagcagccaaaaaataaataatgaatcatccaggcaaaggggaagaaaaatggacttggccagagatggggaagaacgtacgcaaaaagatgaggtcgttcagattggaagttggattggagggcggaccaaaggagaagctgctgaagtagatgttaaagatggagagaagtggacggcagagacatagaggaggaaaagtcagcaagacccgagatgtgtatggagagttagagtgtgggaagtgtgacatgtaactgaatcggatgatggcaactttcactgggcagtgaaagttgagaacaacaagcaataacaaccatacgaagaatctagcaaactcagactttacttctccttttcgtggtcctggaaacagctcagaataaagtggatctggacctctacagaagagagggagctccagattccagtccattacacacatgaagtatgcttgcggcccacaccactgcgcaattcttcaagactatgttgtatattcttcacttacatagaagacatctcagtttccaggaccagttcaggatgtaaaagtgtgagtcacttaccagtggcacaggtcagagtatctccttcaaatcctggtaacccaagaagaaaaggggtcctcatccaggcaagctgattttcctagcatggtcccaattgatagtgatactgtgaagagacacattttgtgctgttttgctggcagtgatactatacctacaaaaagaagctcggtagttgttgtggttgtccgctggtatagcagcttttgtgcagggggaatgatgggatgagctgtcaagaacatctggtgtataaggatccggtgttttccatgggtgatgcaaatggccttgggaactggtgatttagctgttggactatctgaaaaggtaggcttcacctgtgaagactttacaggtgcttgttgggattagttttaggaggccggtgtcctggtggtcaagctgctagatgttaggactcctgctgggatctcagaagttgttatcctatgaccaattttatataaaccttggaggatcgctccttctttcttacctcacactcagctgcctcacccagctagccctcagctcagcagccctaccccgaccattgcaaggccactctgccccactcccctgcctgatttcacggtattttacaaaagtattagctgagacagatggaaattatttcatttttttaagaagtcattatagaaaaggaaagtgaagcactgacgggttaaatcacttgcccaagttcaggaagacagtaatgctgtcgttcacctaacctctgatttaacaaatgtttatgaagagacttgtatgccagacaccaagctccatgcaggaactactgtgtaaaaagaaaaaattatatggatgtataatcaatggatttttttttcttttttttgagacagggtctccttctgtcacccaggctggagtgcagtggcacaatcacagctcactgcagccttgacctcctgggctcaagagatcctcccacctcagcctctctagtagctgggactacaggcatgtgacaccactcctagctaatcttttttatttttcatggagatggcgtttcaccttgttgcccaggctggtctcgaactcctgggctcaagcaatctgcccacctcagccttccagagtgctggaattacaggaatgagccaccatgcccagcctacagtcaatgaaatattattcattataaaaaagaaggaagccctgtcatttgcgacaacatagaaccttgaggccattatgctaagtgaaatatgtcagacagagaaagacaagtactatataatctcacttctatgtgagaaacatacagtgattctcacattatctgtggaatctacattctataccttaaatttatataattctatttgtcatgtatacctcaataaagttgggaaaattatgtacaattaaatgacttttagtatcttcacagagttgtgcaatcatcaccacactctaatgtttgatgtttttgtcaccctaggaaagaaatcttatacccattttctctcctcatttcttt

SEQ ID NO: 664 - DNA, 7022 bp, Homo sapiens
tctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccagcctgggcaacatagcaagactcccaccccttaagaaaaaagaagagagaaaaaaatagaagttgtggagagggaggaggatgcttgaatactttgaccgtacttggcataatagacattttgagggtttttttgttttcttaaaattcctctggatcagttttcattgtttctagtaattatatttatcgttaatgaattcatattctgctctagcccctaaagatagtttgatatgctaacttttgttttgcctttctagctgctaagatagataatggttattgcaaaatgcacgtttttaaatggtctccagtgtggattgcttctgagctgctgatggattgaatacattgagaaggaatgtgtcatttggaatccaggaccagtcagcaaggataactgcctgattttatggtcagaatgctctaactcttatggcatactgatgactttttcttccattttccaaaaaagcaagttttgtcagtctcagtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtgaggaaagagtatgttattctctgagactgaaaaaaaggaaggaagccaggtcttggatggcctactataccatgataacataccagtttaagggcacagaagcaagtgaagtgtcttcagcaaaagaattacatacttagattaaaaattttttttcttttactgaagcgtaaatagtaggattttaagtgggaaggtcgcataggtgactatattctcttccaaaaatgacataggtaggcttagacaggaatagtggtgttacagatgaaaataaaggaacatatgtaaggctctttggaaggtagaataagacttgatgatttattgatttgggggtactatggagaaagaaatctattatttttcccagattttgggttgtgcaactaggtaactagttggtacaatcttggagaatcacaggacaaaatagcataggtacggtttctcttaattgagctgttataatttacaaagcagtagaaacaaatacatgaaaaaagtatgtgtaacttcaatagagtttttattttgaatgcagaaatcttcaatgaaattgaatatgcctcaccatttctagctttattcttatcccaaaatatcaaccacagatgcataagctccagggaatcttttgcctgactagaaaaccttatttaagaaaccagtacctctaaacacatatccttgggcgattagtctcctgtgaaacaactgttatttctacacatctatttagaataaacttggatggttgacttttggaatgttctcatttttagaataatagagatgtaggaaaaagtgaaaatgctctgtctgtatctatttaaagtcttgacagcattaaagaaatttattctcttcctgcaatcactcaaatctgagcacaaaactgaaatagcatcgtaaactgacaaagctcaaggtaaagtcaaatctcagttcagggctttgcacacgtattacatagttgtttttgtttcttattctaatttaaacagaaattaaaatggaaattttaaaaatatactttattaatttataatttacctaagttcacattttatttattccatctatatgcttactatgagataaatttattatgttttgaagctgaaagtaattacaattagcatgtctcagaaaatgtcattcaggaaatagtatttgaatatcaagtttactcctgcaaatcagcttggttttgtattcttatctctcttctcaatggaagtatatgaaattaatctcttctctgtggtggcaagttaaagatacctctgacttaatcaatttctacatggcacctttgctaaactatctcccaaaatagtagttcttatcacaataatgctggtagccatgtgactttcagtgttcttggtgagactgaatcatcttgcactctggatatgcaccatttattatgacatcctgctagaacctgcaatccattttcccagtctttccatggagacgttcatgtctttgtttcttaatgtgtagatcctagacaggggtgatagcaaaaggaacaatgaacaaatattaatcatgtgttgttttaggcaaaggctacacatacagaaatatacatggcataaaaaacaaaatccctactgtgatgtgatctaacatgacacaaatgctttagataagtctcctgaagaaggattctagacggttaccgaaatgaaaatataggatattattaataagaaacaggtagctatggatataagcccactgttagcagtgactacaacctctagtttgtaagtgtctacacaagcaagtttcatgacataaggaaaatcacagtgaaaactacctactctattagggccacaaaaaggcaagtttatggcaaaaacaaactgagatacagcatggattatcctgactatccaggatgcctccaacaaaggaaacacacattttggggttcattgtggtcaggtaatggggaggcttacagattggcagtgtacctgctctatgccatggttatgagcagcaccatctcaatttttacgcatgacacaaatgaaaaatatctgtatgatgcatcttggaaaagaaatgatgctgcagttagtgaaaaagtcagaactgtaggagaagacccagatcaagaagataaatgttggccagtaggcagtacctggggaatttaaatgagagtcaataattactgtgaacacaatgaagagattttccaggataattcccatgtagaacacagagaagaaccaaaaaagaaaaagatgcatctcccaagagcttgaaagtccaatcaatacaaatttagataccgcagaattatttactctatccattggccattgactcagtcagtagagaagaagctttagtattctgaaggaagaaagtgaggaagaattgagaaatacaaatgctacacgttgaagtgttgtttgaccataaatgattttgtgggaaatatgtggcaagtgctgaaatatgaagacagaaaacacacaaagagagaaaatgaaagaaagataaatgaattggggaaatgcggtgataataagttatttattaatttattaataaatcatgtgatgataagttattattaataacaattagatcataagttatttattaattattaataacaattagacaagaacagcaaagaaaaaaatcatgtgggaatatggcaggtggagtgaaggattagaggggcaaagaatataatttccctaacggagtgcttctttaccatgcgcatcgtgcagtaattacggctgcttcagtcttactcacccatgttcaacacaacgtcgtccacgtaagaaacagtcaccgtatttgaaatgttaatcgccttaactgtatttatctgcatgtacccttaggggaggtactctctgatcaatcttctttttttttttttgaggcggagtctcgctgggtcgcccaggctggagtgcggtggcgccatctcggctcactgcaggctccgcctcccggttcccgccatgctcccgcctcggcctccccagcagctgggaccgcaggcgcccgccaccgcgcccggctaactttttgtatttttagtggagacggggtttccccgtgttagccaggatggtctcgatctcctgacctcgtgatccgcccgcctcggcctcccaaagtgctgggatgacaggcgcgagcccccgcgcccggcctctgatccatctcttacttcacacagtctcaggcattaatcacacactaagagtgactggccaatgagggaaagagcaattaatcccagaggtacagtagcataaaatacaaagacttactcttccgctggttttccaatacgtgtgattccagccaatcacttgttgacttgttggaggattaagactcactttaaataaagtgaaactcaacccccacaaaaaagagtatctgaaactcagagagagggcttttccatgctttgttaggaatcagagttggtgcttttgagagtt

SEQ ID NO: 665 - DNA, 4985 bp, Homo sapiens
accagaagcagaggctggcaccatgtttgttatgcagcctgcagaaccgctggggacagctctctgaaaataggaataaatagtggctcctcgataaacaccttcttgcctacagcatgtgtgactgcaaacacattcccacttcaactaatccaagacgagaaggatgacaaaataagagaaatcatgggaaaaactgcccatttctgttttgtccactttgctttgggaagtgagagctatagtcattatcaccacatcccctggcatccaattccgacaatgatctctgaccttgccactaagagtaaaaaaatgtgctgaacacctttactgggatactagtcactgattaataattcaattccagctttcctggaagccagaagtcaaaatatacttgggatttctataaatattttttaattatgaccatcgaactccaagtacttcagatttggaactcggactgctttccttgctcctcagcctgcagatggcctattgtgggaccttgtgattatgtagtgagacgagcatgagtggagcaggagacggctgtcccccacccacaaggaatatcagatgatggttcagcgatcatcacattgcctctctgaaagtgataaattggcagctggcaccagggagaggctatttcctgatggcccacacctgttgcactaagatgttaatcgaatgcagattccagggagaaacaacttcctgggcatgtgcgtaagagacaaaatggcagtaaaaattagagaatgagatcagaatatggatacattgcaagaggtggagccctggaacaaaagtaagagattatgcagtgtcactccccagacatctataaagatttctactgaacaagtcagccatcgaagcagattattcaccatctgtggtcatcaattccaaaggaatttttgtttctggtaatggccaaataagcatctatatgaatattttctacagataataaatataaactgtgaacaaatgtaaaaagaaaaaaaaaagaccagccaaaggcactggaaatgaccctaaaagagcatattctgaagagtagtctacaatagaaaagggaaaatgacactgactgagtctctcatttactttagctgttagactaaaggcagttctaaaccatgccatggatagtagccaaaactgcgatagaaagggcattgtctttctgattttaaaggtgtactagaagagagagtttgggacaaccatagctgctagtaagtgagaatacacactgcacaggaaaagagccagaaaaagagaaggtcgccaacttgaaattataaactgtgtccatgtttttagaataatgactttgtggatctgactccaagcaagtcacctaaggataaaataactgaagcaagacttcagctgccacacaaagatagattttgcagaggtgtgatttcaaccaagtaaattacattacagactaaatagaaataaaagattcagaagaagattacaaaactcatgatctccaaaagataatattcataatttccaacatgcatcctaaattactccaaaacatgaataaagaagaatgttttttattctcaagataaatgaaaatcaacagagactgacagcaaaatgactcagatgttggaattggcacaacaaagattttaaaggaattatgctgagtgatgtaaaggaaaatatgtttgaaatgaatgaaaaattaagaaatcacagcaaagagatagaaattataaaaaatgactacataaagacagtaataaggtgtcttttcaatttatatggaagtacaaagttctagcatattcaaagcaattctgaaaaaaagcatagtttaaagcaattctaaaaaagaatagcatagtttaactataataaatgttttcaagaatattataaagctataggaatcaaaataatatggcaatgatgtaaagattgattagcaaagccatagaataaaatttgaagcccagaaatagatttgcacatattgggggggttatttaactttttacgaatatattaaagcaattcaatgaatgtgcagggaaggagtaattcacatgcctgggttgctcaaaccctgtatatttcccataagcatctttcttcagggtgggcccttggctggctcctcaaaaatgagctccgaggctctggaatattctgcctgagaagagtgcttctgtatgtctgacacctccgtccatgtggtaaaaataatgttcaaactgtttacactaattatgtgttttattgtgaacaactgtttttgtaagcctgagactttagattacaaagtacaagtttaaatgggtagtttttgttaacaatgagatttatggtaagtgtatgaggaactaaaatctcaacagctgaggacagttatacaggtgctgcatgcctacgtgactgacccctaataaaacctctgaagaccaaggcaagattgagcttcctgactggaaatacatcacatgtattgccacacatcattgctgggataataaagcacatccataggactccactgtgggaggacacctagaagcccatgcttcatgtcttctagactttatcccatgtacctttacaatttgctaattttaatgtgtatcttttcattgtaaaagacactaaacatggagatagtaggtttttctgagtctagagaatcttcattctctagaatgaagtggtagtggtcatgaggagtctctacccataaataaaacatatttttaatgaatgatactgaaataactatatttatatggaaaaaatgaatctccacccataactcacaatatacctaaaaataattcaaaatgaattattgaccgaaacatagaagcttatacaaaagattttcagaataaaatatggaagaatgactatttgacatagagctaggcaaagttttcttataggtagataagatacaggacaaatgatgacatatggaaaaaatgatatgtttgactttaccaaaaacaaatcatcagtgaatcaaaatactcacaaaatacaactcctacagcaaaacattataaagacaaacaaccttttaaaatgggaaaaatgtttgaacacacattttatacattaagatgtataagtggataataaacacataaaaactgttcagcatcactaagtaagtagggaatggtacattaaagcaacattgtgatatcattacacaccctctaggaatggctaaaattaaaaagactgaaaacatcaaattttggcaaggttagggccaattaaaattttcatacattgctggtaaaaatgaaaatgtcacaaccactttggaaaaaatttttaaaattttttacaaaacttcatatagatccattatatgacccaaccattctactgctagacatacactcaaaatgaagaaacacgtacaaaaagatttctacaagaatgattttagcagcttcacaacaaaccaggtgttggtcaataggaagatgaaaaatcaaaatatagtatagctataaaatacaataatatttaggataaaaataataaatgcatgttataactaataatatcatgactgaatctcaaaaatattttgctgagttaaacaagctttgcacaaagtagtatattatgtatgatcccatgtatagaaatatctagaataaggaaaaacaaattatgatagaaaagatgttgcttctggtgattgggtggagctctgatggactgggaaggagcatgagggagctttgtgggttgatggtaatttatgtaccctgacaggggtttggtttacatagctgtattcatttgtcaaaacttatattaaatggtgcaattaatattgatgcatttcattgtatgtaaattttaccctaaaataattttagacaaattgtaaaacctagttaaagacatatatgctgatattttcagggttacctctcttgatgtctgcaacttactttgaaatgcttcaaaaggaaaataggataatggatggaaatagggagagagaaatggatcgatgtgtaaataaaacaaatctatctaaatgttaaagcttaattgtagatgatgaatgtaggagtgttgaatgttaaattctttcaacttttatgttgaaaaatcgtcataataaaatatttgaaaaatgtatacattgaaatattacagcaagtatactatttttactgtgattttggaactgaagttactattactgatagtatactgaagtatactatttttactgtgattttgaaactcaagataatttcctgaagaaagttttttgacaattttacttttgaaaattcccattgatctgttagttatcttcaaaacgtctggagaaaagtcaggatatatatataacagcaaatgggcaatttctactgttttcattactttggttttagaattgccactactgcttgcttaatatttaaaatttgctggtcttaaagcaacagtctattttccaatcttggggaagattatggtcgtataatataccagatggacgcattagtactgttaaaaaaaaagactagttgcctatatgaattgcaaacttaataaagaaaatgaactaggaagaatgaaataaaaagttctattaggtttattatagtctacaatgttctcactgtccagaaatagtctactggaatttggagatatttcatcattatgcccttatattgtccctattccttctgtttaaatttttataatagctctttaaaatacgttagttgttaccaccttttaatctatctctatttcatgcaagcaataagataaatgactaaatgagctcaatttaacaacattgtaggcatattctcacactttatcttatagatcatcttaacacactcattgcacttcactgaaataccatgcctagttcttaatatcatttctaaacttaataaggaacaagtcaa

SEQ ID NO: 666 - DNA, 2204 bp, Homo sapiens
gaaatcaattcaacaacaactgccccggtgcttccccgtagatagcaccgctggtcagttcgggaggggatgggacattgaggagcaggacagtcttcaggaagcttacagtctgctttgggttgtttcaggaacacagtcatccctcagaaatggattgggtgacaagtggtctgcatgctgcacacgggcactgggtctctgaatgtaaccaaattgttctcctcttatcattcccattcactggtgtacttgtttgtggagcctgcagaactgcctttttcaagaatggcagcttggcctctaaatctgcttcccactgatgggaagagctgacagaagctttagagaggcacagggtgagttcctaaaaccagagtcaacacacactcttcatctgttttgtgcttcactccctgctcatcttcctaaaacactgagtttggtcatatcatgtcctacaagttgtcaatgatttcccatgatcttgtcttcaggataaagttccttagtcaaaagcaatgaagacctgacctaatctgtaaggcaaaatcaacactttttagcctggccttccatgcccttccatgcccttcgagcccccagagcacccatggcagtccatctctctctacttgtccagagggacactctcttagagccagtggctcctactcacggttccccgaacacgtcgtgggaatgtttgccttcataccttcccagatcattttcctgatctcagacaccctccgtcctcattcattcactcttcaattgtccaacaaatatttgttgctcatgcaacctggatcacccacatagtttcaagactgcatcttctaaactatttaaatcctatccattcttcaagaaatgtttcatgacgcttccttaactgctaaggacccgcagattctcttcctcttgggactcacacactgactcatctcccgatcttttggtgctcagcaaagtggaggcttctgttttggacttagagtcaagaccattaaataagactatgctctaaaaagtacacctccgtggcccggaacgagtgaattaacatctatgagtttccatttccttgtctataaaattgtgaaattgcaacttaagattagttctgaagattaaatgaggtaacataggtgaaaatgctacatttatgtaagaaattactctttcataaggatgtcaatgtttaaatacgcattttctcaattttgttaatgaaatactttgaaattcttttttctaatgaaacctgctgaatgtaaaagagacccgtactaaagaaagataccacatgaagcaccaagggtctctttctggatctatcatgactcttgtgactgtttcagcagcacagaaattaaaggcgattgttattctggaggaagacaatgagtctcatctatatcttgtttgggttgattttgtaaacagaacattccaaagatcattcttgccttttgtttccactgagaactagaataaagtaaaacaaactatcaatttaaggaaagcctcgaaattgttagcaatttcttcagtaactttcatccatcaactgattttatgaacacaaatttgcagaaatgggcaagaaaaactacttaactcattggtgggaagcagtgggctctctaaggagggagagatagcagtgatttcaccaccggaccgtggaacacaaagagcctggaagagtctatcactttcaactgaaaccgcaagaagaactaagtaggttaagccctaagaatgttcctaggtaacctacttgagttgaaatttgactaagaatccttacaccctacctaagagaggtaacgctattaggatcggaagtgattggaagctttgtttcagatctcgtccaaaagggagaacggtcaatgacaaagctgctgtgaatagtattctgggggcgtggtggaaccccgattcactgctatctcccgaatcagcaacttgacagagcgcgcctcccgggccttggaagccttccattccgagctggctgggtgggactcaggttttacggtatgctggactttttccccgtgagttaaaacacatttatagtaactaagtggttaatgatgagaaaaaaccccaaactactgtactaataatcaacctctgctatttggtttgtaaaaaacaaaaatacatctataaaaagggttggccgg

SEQ ID NO: 667 - DNA, 5819 bp, Homo sapiens
aagtggaaccggagcccgggcgcgggcgcccacgttccattcccgggaaggcctgggaagggagggaatcgctcacccgccagcccgcctgcagggaaagggctcctggagctgtcgatgcctgcccgacgctgagataactcttgggtcccagttatccaccagccacttctgcctcgattcaccaaagggcagggaaagaaccttttggtgagatggtgtgaattagcgacatccagcctgagctgaagtctccagcgggtcaaagaaatctttccatttgcaaactaccaaggctgacttgctgtgcatttggcgggcctcctgcccctgattctgctggtttggagatgctttctcgctctttggttggcttctgtctccacacattgtggggatcccagggattcgtcataggactctcggatcgctggtgcctccactgtgatctccggtctccctgcggccagcactgacttctagcaacagaatcctgcatgagggcctaggcacagaactttatttccactcttctgaacacatctaatgtgatgctctgcaattgtctgaaatttatcctaccctaagtcattatcttgtccccttctctggaacctgcttcacttcccgtatcccaagttctggaagctggacggtccaagatcatgctgccagcagatttgtggtctggtgagggtctactttctggttcatagactgcacctcctagctgtgtcttatggtagaaggggcaaaagagctcccttgagctgcttctctaagggcactaatcccatttgtgagggctccagccccatgatgtaatcacctctcagaggccccagctccttataccatcactttgaaggttaggatttcaatgtatgaattatggggggggaacacaaacacccagaccatagcatgtggaacaccgtctgacatgtacgtgctaatagtgttagaagtagtctttgctcttatatcttaattatgataactgttttcatctatgataattgcttttgtggatgtctttgttagtgttagaagtggtcttagctcttatatcttaattatgataactattttcatctattataattgcttttgtggatgtctttgttccagctaggctgtgagtttctggagggctccatgccaatcctagaggcttctataacaaatacttactaaacacctactatatgccaggcacaatactaggagagacggcaattcattaaataggggaaaagcctagctctcatagaggtgagcttatattttacagggtttgaggggatttagaagagagattgcccaggctggcatgggtagggaaggtaggtagggccagatcataggaagcctcagatgtgtgttaaggagtacagactctctatagttaatgataacataaataggccttttttttttctttctagagtgtcagttcctatttaaaacaaaatctgaaatcttcctgaaactatatcctcacccttaaaagaattcaaattgattggaaatgtgtctgcacatacataattcagagttatatgtgtgcttacccaaaattttctttacaaattattgcaagaaatgtaatcattaaaaattcgcagcaatttttgtgtaataccacttaaatagcatttggtccattgcaccctaaatcttacattttggagtttcaatattaatttcaatcttaattttcataaacccaacaccagccatctaatatatttcctgttcaaatacttattcattccttctggcttactaaggttcccttttgtgcttttatgttaatttgtttctcccctttagagtgcccagcttttgctcaagcaggccctgaggctgtaaatttctctccctacccacggaattccttcctttaatacccatctgaagaccttacttctaataagaaattttccattattaaataagtgacgtgcacaaagtttttttcatctcatttccacaatcctgttgtcacattacaaatttccatcatctgtagcatctggaaataccgagtgggatagataacatggcctggctgctgtttgttttttttttcatcagtgtgctagatcttcctggacacgctgcacaaatctcacctcagtcttagtgccaccgtggacgctggaaggagccattttaaaaggcaaccttaaacagttcagtctaatttaatattagtggcctccacacctctgactcttgtattattagaattgcctgtttggcttttattttccagtgtgaactgatgaaacagacacaaagtgaagtacccgttggtttcgcggtctccacctcgagaggaaatccaaaaggagtttctggcatgtgtggtgttgcttagcaatttacccaaacaaacatgtttcctcctcatttttttccccagtacttatttactcaagaacattgtaaaatcaatttttaccacttgacatctgaaatcattagaagaaaatctggtgttttgggctttatgagaagaactgctaaccacacatgaatgcagtatgctgctaccacaaattacgcagttgagtttcccacatttggagaaatcacagggatcagcaagtcttcagtggaatagagaagccttgccctagggaaaactacccttgtggtcatggtatctaccctgcctggtgaagaaggtccttgcttccccttctccttccgccatgattgtaagtttcctgaggcctccccagccatgtagaactgtgagtcaattaaacctttttcctttataaattacccagtcttggatagtagctttatagcagtgtgaaaatggactaatacagtagcctttgacctttcttcttaaagataaggatattagcaaatgtaaactttttaccaacaaacaccttttaaaataaatatcttttacatttgccaaagtctataaactttcattttgtggtacaacagtaaatataacttattttatatattttaatttttcattgttcactaccagtacttttttaaaagtatattatctttatagatagtcattaacatattgttaaatttatattttatagaagatagttcctagtattgtttaatttgtagagataaaagagaaaatatgcagatccaacttctaagagcattcaatattatacaccaagcttattcctgaaaacaatgacccagaaaaccacatgaaagagttttattatggatatcctaaaacaagtaactataagtttcagatatatatagaatattccacagttcctataataaaaattcatgagttttctgatcaccttcaatgtttgtactgagttaacacaccgctgttacattaaagcaaaccattaaaaataaagctagttttctctctttttttcaacttttattttagactcagaggtatatgtgcaggtttgttacctgggtatattgtgtgatgctgagatttggggtatgaaagatcatgtcatccaggtactgagcatagtacccaatagttagttactaccagtactttactaacatgaatttttcttccttgaatttttttctctttatttaaaccttctggagtagattttttattaggtgttttttttttggtttgttttcaaagaacaacccattaatgcttcattattccccaaaactgtttaaaattaagaaggcctttctgttaccatagacataaaacgaatggattgggcattatatttttcagtttaatcttttctcctcctctttaggattttctaaatattcctccactttcctctgccattaaatgttgttatgggaaaagtaggaggtcagattaaacccattgtttttctctcaggctgagtagatgagtattttattatgattattatttggcccaaaagttatgtctgtttagtgaaattattattattactattgttattgttatcctgctctcagatacatctttctgttgattattcagcataattatttacctaggagatattgtgcatgtttaatcagcaaattcaaatttttacttattttaacaaggttttcttcttttataatttcaaataatctgctgtttcattaattctgtaaatttagcaatacctattacgcatatgttgagctactgtgtcatgtttctgtattatctcctttctaatttctctttctgtcattttctatttttatttttaataggatttttataaatcttgaccttcatattattgtaccattcatgattttgtggttttaaaggtggcttttcttttcctaattatttattgaaaatctttaattcctcctgtgaattctgccagctcacttttcatttttccatggtcatgtattttattttatatttttcattcttttttaaagttaaaattatttttaaaggatttctgttcctggctctgatggagcaacacggacagatttaccctcttacttaaacaaaatacagacaaaatttataaaggatggttctgaaacatgggacaacaggcagtataaacagtaatttttcaaagaagataaaaaaaggaagtaaaccctatggtttctctactgattccctagaaagagatttcaagctatcagtctcactcaattgagaagacagagttcattgagaatttggggaaagtcaaagtggacagaattcacaaagaactaaaaaaaagagtattgtgcagagaaagagctccagctacctccacagagtttcccttgagttttcagatcatgcgtttggtgaacccacctgaggcaagggaaagaactaccagaaagaagcaggtggaaaaattcctgatgttcacatagaccgggaaatttctcaagtttttgtcatctgaattgaagaaatcttatactgtatgaggtgttgaagagaatactcagaaggacaatgcctccgtagtaggaccaaactagcctagagtaaaggctggtctgtcttgtatgactccttgtgaaactattctgctgagtatgtcaccaattttcttagcgaatctaagtgattccaagtaataagttgaaattttcactatttgtatgtttttattgattattcattgtggttctaatagtttttggtttataatattttgttggtctgttatttgctgcatagtggtttatgatagttatatctttattggatctttaacaatgtagaataagttctttgtttcatttcatgttatttgtttctaaattttacttcttatttaacagtaatgttgcaaatctttaaaaatgttttactttatttgtaaggaaaacacctaaagcaaagtgaaacaataagtgatgtaggatctattattattattttccatcatgtgaatctttgtcttaacagagaggcttcgtctatttatatttgttgttacaattgatttctttcatcattctgttatttcagtgtttctcttgaaaaataggttcttgttattcaatgatttagttttcactttatgtatcgttttctttattttgtccttcatattttgcaagctatatagcctctgttaaattccattaatggatatctttaagcactctttgacatgtaattttctaatgtctcagtaaataaagaatttgtcaacataaaatgtgtgtgtaggccaggtgcggtggctcatgcctgtaatcccagaactttgggaggccaaggtgggtggatcacctgaggtcaggattttgaaaccagcctgaccaacatggcgaaaccccgtctctactaaaagaatacaacacttagccggacgtggggg

SEQ ID NO: 668 - DNA, 9609 bp, Homo sapiens
gcgccgacgctcggacaccgcccccgagtgcgaggcccggcgcggaaccggcagccgagagcctggcgggggcggggcgcaccgcgccgctcccgggagtctccgggctgcggtcgcggaatacgactttgatccgcgggtgagggctctgtgaatgggcaagcaaagccctctgactccgggcctcgtggctgggtgctgtgtgttaagcgcctgcgctgtactaggaccgggcgtgccgccgtcggcaaaaagtgacgctttcttgaagcacaaagtccaggggggacgaccaagcggacagcggatgcgtcctgcgccggtagccaggcgaccggtggaagagcagagtccagcgcgggcgatgcggcggggccaggcttgctgcgccgcggggtgattgggagaagagccttcctgcggggtggaggacgaagagctgccctgaggaggtcccggagtctggtgggaacggcctcttcgggactgctccgagagacggtgtgcagagcctggcgtgctcgccgaggtctgacaggcagcccggggctaggtcctgttggatttttttttctaaggaaaatgggaagtggtggtagggtttgagcagtggagtcccgggcagttttaaaaggatccctgcagctgccggctgggagggcgtgggtgcgcgtaaggccggaatcacagagaccaggtagaagatgattacgagaacccaggaacgtggccctcaggaggccggcagtaccaaggggacagcagctgggaggagagaggcaggagatggtcaggggccagaccagggaaggccgcggagaccgcagaattcgctctgaatgagtggggaggcccttggaagagtaaggggtccaacttaacttttttttttttttttttttttgacacagagtctcgctctgtcgccaggctggagtgcagtgcgatctcggctcactgcaacctccaacaccccgattcaagcaattctcctgcctcagcctcctgagtagctgggattataggcacgcgccacccagctaattttttgtatttttagtagagacgggttttcaccatgttggccaggatggtctcgatctcctgacctcgtgatccgcccgcctcggcctaccagagtgctgcgattacaggcgtaagccaccgcgcctggccaccaacttaacttctgccaggatcatgggaagtggtagggtttggggtctgatttcaagagggagctgctgtggagtatcagcacagcttactgagatatcagaaaggccttggtaaagagccctttactgagacagggagcacattttggcagaggtttgaattggagcgtgttaagtgtagtgtcttcttcaccactgtgacgtgaggtcctggcgcaaataattgagcacagaaatacatgtcaggcattgctaggcacaagggtacagccagtgagcagggctgccatggtccctgccctcttagagctgaccttcaggtctgagggagactgaaaaataagtaagaatacctccagccgggcgctttggctcacgcctgtaatcccagcactttgggaggccaaggtgggtggatcacctgaggtcaagagttcgagaccagcccaaccaatatagtcaaaccccatctctactgaaattattaaaattagctgggcgtggtggtgggcacctgtaatgccagctactcgggaggctgaggcaggagaatcgctggaacccaggaggcagaggttacagtgatccgggatcgcgccactgcactccagcagcctgggcgacagagggagactccatctcaaaaaaaaaaaaaaaaaaaaaatacacctccaatgctgaaagctacgaaggaaacaaaaccatgtgcgagtgatagggcagcccctctgggaagtgacatttgtgcccagatctgaagaaagaaaaggagccactcatacagaaagactgagacaagatgagctttcgggacaagtcaggctctagggagaacacctgacgaggaaaatgcctgggcagtttgaggaactgaaaagccagtgtgtctggagcttagtgagggaggcagagagcacgggaggtgtggttaccaaggtaggtgggaccggctctggccctgggtaaaaagtttgactttcattccaagagtaatggaaaataatgaagaattttgaactcgaggtggtgcatgcctgtaatcccagcactttgggaggctgaagcaggcagatcgcttgagcccaggagtttgagattagcccgggcagcataacagggcagcatctctacaaaaattttatttttggccgggcgcggtggctcacacctgtaatcccagcactttgggaggccgagggggggcagatctcctgaggtcaggagttcgagaccagcctgaccaacatggcgaaaccccgtctctactaaaaatacaaaaaattagccgggcatggtggcacgcgcctgtaatcccagctacttaggaggctgaggcaggagaatcgcttgaacccgggaggcggaggttgcagtgagccaagatcacgccacttgcactccagcctgggcaacaagagagaaactccatctcaaaaacaaacaaatccagaccagcctggctaacatggcaaaaccccctctctactaaaaatagaaaaattggctgggcatggtggtaagcacctgtaatctcagctgcattggcggctgaggcaggagaatcacttgaactcagaaggtggaggttgcagtgagcacagatcacaccactgcactccagcctgggcaacagagcaagactctcaaaaaaaaaaagttttgaagggagcagatccactttaaaagctcacactggttcttgagtgatgaccaaatggcactgtgccttatgcagagccgactcctggcagtttgcacaggctggaggtggagctgcagactccctctccctctcggccttgcctctgtaaatgggaaagccgttgacattcacaaaagaggggcagggaactgctacacaagagcagctacacaagagggtcctttggtccacacaggaaacaagccatagtgatgacatattttgaagctgttagatgttttgtttccctagctggctattatttttgtatggcttgtctttctcttttgagtatgtgtgagaacaggatgggttaacattagggaagagcacagaagaggaaggaaggaaagaaggaagggagggagggaaaggagagagaatagggatgagaagctcagcttgtagaattggcaggtgatgtttgcagtcattaatcatttgagaagtagagagagaagccaagcaggaaatcttcatactggaaaagaagtgctcaccattaaaaaaaaaaaaaaaaaaaatccagtgtggttcacagctgtaatcccatcacttggaggctgaggcaggagaaatacgtgaagccaggagtttgagaccagcctgggcaatataacaagacccacatctctacaaagagaaaaaaaatgtaaaaaaaagaagctttaaacctaagacggcagaattcaagactgttgtccttgagaacttcctggctctggaaaaagctcagtgagttagtctcatcctgtcgttagctctgttttttaggggctcactttgtcttcacgacagtaccttgcaccattctcatgggtatcccagggtggtgcaaggcagttttctgcacttcccagaatgccctgtcagctggcttctgggtaggttctgcaaattggaggcccctgtgaaagatcgctgtggggtgggaggaagaagctttatctgcctgctggctgcagggtagaggactgcagtggggttatagggatcaccacctgcacatgtggagctttgagcggcttcactctaagtttctgctcaacagtggcagccctggagtccttcgggggcgagtgtgggctcctgggctccaggccaggggcagtcccagcttcctgatctcgaggtagcgtctcctcccttttgctccatagcacctcgcccttctcagtgacgtgcctccttctcagtcatgcgcctccagctctaacaatgtccttgaaaacaattcttgaccatgcgccgtggctcacgcctgtaatcccaacactttgggagtctgaggcaggcggatcacttgaggtcaggagtttgagaccagcctggccaacatgtaatcccagctactccctccacttgatttgtgttccttgaagaaatttgcataatccctgtatctggttggcagatagcagagatgtagcctcagtctttcctttaaaaattttgctttaggcagggcgcggtggctcacacctataatcccagcacgttgggaggccaaggtgggcagatcatgagagcaggaatttgagatcggcctagccaatatggtgaaaccccgtctctactaaaaatataaaaattagctgggcgtggtggcacaagcctgtaatcccagctatttgggaggctgaggcaggagaatcgcttgaatccaggaggcagaggttgagatgagccgagatcacgctattgcactccagcctgggcaacagagggatactccatctcaaaaaaaattttttgctttagggccaatcgtggtgacacacgcttgtaattctggcactttgagaggccgaggcaggtggataatttgaggtcaggggttcgagagcagactggccatgatggtgaaatcccatctctactaaaaatacaaaaaaagccaggtatggtggcatacgcctgtaatcccagctactcgggaggctgaagcaggagaatcacttgaacccgggaggtttaggtggcattgagccgagattgcaccactgcactccagcctgggtgacagagcgagactccatctcaaaaaaaaaaaaaagggccggacgcggtggctcacgcctttaatcccagcactttggaaggccgaggcgggtggatcacctgaggtcaggagttcaagaccagcctggtcaacatggtgaaaccccgtctctactaaaaacattaaaaaattagccgggcatggtagtgggcgcctgtaataccagctactgaggaggctgaggcaggagaattgcttgaacccaggagacagaggttgcagtgacctgagattgtgccactacactccagcctgggcaacaaagcaagactctgtcttaaacaaacaaaaagcccagtgtggtggtgtatatttgtggtcctagctactttgaaggctgaggtgggaggattgcttgagtacaacatgtagaggctgcagtgagctgtgattgtgccactgcaccccagtgtgggtgacagagcaagaccctgtctcaaaataataaaattaacattcattaacaataatgttaatatatatgttaatgtatatgttaatcgtaatgtttatattttaccatgataaaaacattttaaaatcatatatcaactcttgccgttctcctgttgaaaactctccaatgacttcccactccatcatcctgtgggatgggtccaccatgctggaccacaaggctctgcacaatgcggctcccaccagcctctccccttggcccagattgcttcctcctacccctttctctagctgccaggccccccaacccccgcatggagcccttcagcagctctgtgagctccctgcctgttggcagccatcacagcaacgggctctggtgtgccccttgttatccctgtattcaggccattatctgtaatgacagcctggcataattttattttcacaatttgtataattatattctattgagctaaatgatcattataatcattattaaatatttattaagcacttctagctgtgcaaacataataagatgtggcctcagctcttaaaatctttcttcctaattccaacccaaattcatttcaacttaaccaatcttccttcttggagaaggagggaacttcggcgttttgtctgggtttccatgcccgagcttataggagcttcttagcaatgctgtggagcagatgctattgacttcagtttacagataaggaaacaatcagactgaggaagctagtattaataagtagcagagattaagatttgcctgtggttcttttttacacaaagcctctcccactcctttcatgcactgttagccaagtttactagaataggcaacttcctttttaaaaaatcctgtttacattttaggtgccaaacactgtgctaatccagtgggggaaacatatgctcaaaaagatcactctgagaccaggcatggtggctcatgcctgtaatcccaagcctttgggaggatgaggtctgaggactgcttgaggccaggagtttgagatgagcctgggcaacatagtaaggccccttctgtacaaaaaatttaaaaactagccaggcctggtggcatgtgactacaggctgcagtaagctatgatcgtgccactgcactccagcctgggtgacagaatgagaccctgtctctaaaaacaaaacaaaactcaagcagtatcctaagtcagggtccaagcagtaatggaaatgggtgaagctgacaggcgagtgatagagaatggaggggtctgtagcaaacgtgacgactctggcttacctaagagggcagccaattttgccatgaggcaatgtgggatcagtgagtgctgttccagtcttcaatttcgatttataagtaaaatctccaatattttatatgttggcaactttggcattcctttccttaaacctcactgccaccccgcaccccaattcatttcagtagggatcagatagccaacatccttataaaatcaaaagtatacaggccgggtgcagtggctcacacctataatcccagcactttgggaggccgaggcaggcggatcacgaggtcaggagatcgagaccatcctggctaacatggtgaaaccccgtctctactaaaaatacaaaaaaaaaattagccgggcgtggtggcaggcgcctgtagtcttagctacttgggaggctgaggcaggagaatgttgtgaacccgggaggcggagcttgcagtgagctgagatcacgccactgcactccagcctgggtgacagagcgagactccatatcccaaaagaaaaaaaaaaaaaagatacaaatcttaattggcataaaccagtcctagtaatatcatgccctttggccagtcgttggtcacagggtgagctaatgacccaactctgacaaattacatgtaagaggaatactgctaaaaagatattttcggccaggcgtgggggctcacacctgtaatcccagtactttgggaggccgaggcgggcagatcacttgaggtcaggagtttgagaccagccttggcaacatggtgaaaccccatttctactaaaaatacaaaaattagccgggcatgctggtgggtacctgtaatctcagctactcgggaggctgaggcacaagagtcacttgaacccaagaggcacaggttgcagtgaaccaagatcatgccacggcactccagcctgggcgatacagtgagactcagtctcaaaaaaaaaaaaaaaaaaaagagtatcttttcttcagtaaaaagacaaagctgtttgggtgcagtggctcacacctgtaaggagaattgcttgaacccaggaggtagaggttgtagtgagctgaaatcataccactgcactccagcctgggcgacagagcaagacactgtctcaaaaaaaaaaaaaaaaaaaaaagacaaagccttgagggctgaggaagaaatgtggaaactgccctttccctttgttcttgtctaatgcagtcacaaagtctggagcagtagcagccatttttcaaccatgaggcagtaagcatgaagcctaaaaccagcatgccaagaaggacaaagcagaaagactgaaatctctaaggcccttgcagacacccttactgcatcagttccagacttggctcccatagctccagatgtggccatggccactgtatatgtaagcttgatggaataagcactaatgcggcaccttagagctgctggaaaagagaccaatggacatgtacgaatgggggatcctgccatttgccgagtaaaggcctcctgtgtagaaggtgtcctttgataagcattcacatggaatacaaatctccactcatctctccccaatccaaaaggttcatccacaccccctctccagaccttcttgtctttctgtctccaaacatgttctttccaagtttctgaaccttcaaagtgttagtgactgtccgtgaactggagtagacccaacccttctggctttcttgcttgctttttttttttttttttttttgagatggagttttgttcttgttgctcaggctggagtgcaatggcgcgatctcggctcaccacaacctccgcctcccgagttcaagcaattctcctgcctcagcctcctgaatagctgggatcacaggcgtgcgccaccacgcccggctaattttgtatttttagtagagacggggtttctccatgttggtcaggctggtctcaaactcctgacctcaggtgatccacctgcctcggcctcccaaagtgctgggattacaggtgtgagccaccgcacccagcccacttccctgttgattctgtctctctggaagaaccctcactaataaactttacttgaccttcaaaataataatgctcaaaagacaccctcatttggggtgccagagtctggcatttgttctctaccagtgcctggtagcaaatctgaagctgtgtaatgcttaaatggagaatagtcattttcagaggagggtatatctttgctctaaaccccttggagtctgtgctgtgacttttattttttatttttttttttgagacagagtcttgctcttgttgcccaggctggagtgcaatggcgtgatctcggctcactgcaacctccgcctcttgggttcaagtggttctcctgccccagcctcctgagtagctgggattataggcacccaccaccacacgcagctaattttttgtattttttagtaaagactttaaagacatttcaatttcaccatgctggccaggctggtcttcaactcctgaccttaggtgatccaccgcaccttggcctcccaaagtgctgggattacaggagtgagccactgcacccagcctgtgctgtgactcttatactggtccctgccagaacttacaggagcatgacctgtcacggacaacctgagcaccactggatctgcagggttatctgtcaaatgggtcggagcagcatactcaaatgtggtcgctattatctctaaaagtcaaggaaagccagcagtgcaggacactcaaatccagacgtcattccactagctaagctaagcaaacagttggagctatcccagctgtcgaagctaacacgctgcatttagactctcttgcaagtcagctgtgttggtaactagaggctctggattgacacattagaatccactcccatacattccccaggttttggctggtaaaaattgattgatatcccataattccttcagcatgtgaacttctc

SEQ ID NO: 669 - DNA, 1851 bp, Homo sapiens
gtagaaatgagcaattgcaactagaagagcctgtgtgcccacaatcaagggtaaggaggagtgtcatggagcagctctctactgccctgagaatgacatccccactgttcaccatggccttaaatcccctgcgaattccacctcatcctctgccacttcccgtcactgctctgaagatgccctgatcttgtttcagtcccttggatgtacccagctcttctccatctttgcatgtgtcatagcctcttcctggaaaacccttcctgctgctcatcccagaactgactctccatgtatttactcttattttgagagaagggggcatttccaccaccagaagggaacttgctgtcttggtagccattgtcccctgacacctggcacatctactctatacagtcaccattcaagtggatgttgaatgagtacacttgtttcacagtttggttgggtaagccccaaagcttggttcccggtaggatcaggctttatgagtgggctgagtttctataaaagtctccctaccagtttccaatcttggtgaaactatgtctgtgggcacaaatgagaaaacttgccattcgtatcaccggttacccagctgtggaccatgtgggccaggtccacagaagagccttatcctactttcactttttatttcctgcagtcatggggacagtggggcaccaccttttcagaaactctaagaaagagtgttcatgaaagtggccagagagttttacaattttgccattaggaatgattaaatatccatgactaatgcctctgtgattaaattgtattgggagttccaaagtttgctttttgtgctttaagagtaaaatgagaagaaagcaactgaacttctcatttagaaaatatttcttctctccttggccaggtgcagcagctcacacctgtaatcccagctctttgggaggccaggcagtgggaccacttgatgccaggagttcaagagcagcctggccaacatggtgaaaacccatctctactaaaaataaaaaaattagccagacatggtggcatgcacctgtagtcccagctactcgggaggctgaggaaggagaattgcttgaacctgggaggtggaggttgcagtgagccaagatcatgccactgcactccagcctggacaatagagcgagactctatctcaaaaaaaaaaaaaaagtaaaaaaaaaagaacatttcttctctcctggacccagaagcaccttccagacatgaatccaggaagtaggaatgagagctgccactgcagggtagaaaatgcaagtaaaccttatacgagatgtaacacccaggcagggtgagcctcaggaaatgggaacgctccaatggcacggctcatctggactgggccactctgagtgccagaatttgtataacgttttagatttgcttagatataggaatatacaagaaggagaatatataagaggatttagcagtggttatttctgagaaacagggagtacatgtagttttgggtttttttcttagctggatttttttaagtttctaaaatgaacatgatttacttttggaattttttaaaaagcattgaatatttaaaatttttaaaataataggcactcattaagcaaaaaaattataaaacagtgaagttacaaaggaagaagaaaactgttcaaatctactatttatgtttggggtttttaaaaattgtattttttaaaaaaataaactggtttgtcttatttagcatagctataatgatactgtatataaaatatttttgcttgcattcttcaacttatttcattataagtactttccatgttattacttagtctttacagcactatt

SEQ ID NO: 670 - DNA, 3134 bp, Homo sapiens
ctctgcactaatataccagatcctaaaatgcatataaggtggactagcatcttaattctgctagttgattgtgtctttactgaaaagaacccagctaccaatttgcctttttttacaccacaaatcctaattagaaacttgaggttttatagaaatcatttaatgatagagattacatatgtgaattaatgtgaatatagtatctgtgcttcctgtgtctatgactattttaagatataattgtgctgcgctatcagattaacatttggaagtttctagaacagttaatgctatttacagaaaggagtagaaactcatcaactggcactctctttgatttttatattttaaattaactctcttcgatctcaaagtatattttacgagtaattttattaggaatctcttatagtgccccaatgggataagctatttgcctattttcacagttctgaacttggaaagaagcaaagtatatgtaactaaaccacatatttgtctttttattgctttttcccttcttttatatgctaaatcaaatatagatttgtggatagggaagcaatatgtgaatcacaatgtagcagaggcagaccaagcattacattattatttagagctggactgcaccaattacttgtcctcgtgccaaaggcaaatatgtttgcacctttttttttttttctgattctcaggttgattaatactgctaatgcaaatgctcaagtagatgtttaaaaactttacaaaatagattcaagtgatactttcttttaaaagtgaagagttgatgattacacatagtaaattcatgaactacagtaggtttgtatcaaacaattttttttaatgaaaatctgttgaggtgtacacaatatgcttcttgattgtattagtccttggtctctgctagacctcatgagtttcatcatttagaaaaggggtagaggatgaactaatgtctccttcagatgtaaacatgaaatacctagagttttacttgcttttcaatacactgaataattttaaatgattctgacactgatgtagaccctttgacttataaattctgaggaaacaactgacagcataaaatatttacattcttataacacagcacagtgactttcttctttcaagattgtagctcagagaaaagatacaggattcaattgggggttcaataggatagaaatggagagattcctttgtgttgtagtagaggcattttcctaaggagtatagatttatactttgcattttcattcatcatcccccagaatcatggtcaaggtgtaggtcactccacacagctgatgctcaggttattcccttgtgagaattatgagaataaagctcccaagatatgtgaaagtgcttaacacagtacctggcacacagcactcaataaaagtttggctctattatgggatggttcaattctggtttaaggaaggaagaaaggttattatatatgtaccactaagcaaatatatatatatatatatatttggggttttttttccctaatattatttgggtgtcccctgtgcttctttaggatgtagttataactaaacctgttatacttgaacatcactaagagaagtaaattattatgaagctagcaaaaatcttgaggccaaagttgtttcttaacagctttaataatgcttgttgattttgaataatcctttaaaaagtggaccatttgcttattttaatatcacgtcagtaaaatgttagtattaaaaagatcagctttttatggcattgaagaatgtatctgctaagacacaaaaattgcatggtaagtataataggtggaggaggaaaggttgtaggccggatgaaaatttaactgactagaacatttattcaggagtgtaattattttcccttaccccaatccctgtgtacgtgttgggtatagttacgacattatccggatttgcaaatagacacaactttcagtcttaccctgtttattgtttaagagtgatagactgttgtcctcttgctggtggaaaatctaaggtggagcccactcttctatgctgaagttcaccaggcagagcagttttcttacaagtcagctactctgcttggtttattttaggttttggtacttcacgtaagcactgttagaaggtacaagtgtattaatatcactagttttgaggcgcttgggtacatttgtttttaatatatttagaatgtgcagtaaacttttttctcatttttttttctttttagcaaacttgttattttaggtccaattattgagttgacagtctactgtgagaatgagatgacatatctactgtgagaataccataaatgatgaatagtttatttgagaacttttatactcagtggtgttttatatattaagataaaaatatgtacacacatgcatgtcacatctctctactgtggagttaatgtgaatttttaaaaaatggaattgcaaccacaatcatatctaagagaacattcactcctagtgagggtttacaaaagctactaagagaataaggtagatgataatgcaaagggtcatgatttggggttatttttgttttattttaaaatttatactgctacttttgaaagaattgtttttatgactatgctctttttgtgattgaaaagtcatctaatagaagctgtatagaagctactttttaattgctggcaaacagctttaagtgcactttctttgattacacttccattttttgttaaacttgaattttctgaagccttttatgtaccactaagcaaataactttaacctttaaataaagcaaatttacatctttattgtatttctacttgttacaaaacatacttgctaaagtaacttcagtcctcaaatatagctgggaaacaattatgagatagactcagtctccccctcccaccccttttcccctgccatatctaattaagcactaactgattttattactttattgcctttacactgcttattctttttgactgaattctgtccctgattcactgttttgtttgaaatttaaagttattttcttactgtatttatcatacctgttttaatctgttttctttaaatgcaataaatcccaaatggattgcatattctttat

SEQ ID NO: 671 - DNA, 24702 bp, Homo sapiens
agctctgcccacttagagatattcccctcactactgtctttcaggacactcctaagtgattgcctgtggcacttgcacatcaggactgtcacctttgggtccccccaaaaactagggcagcaatggaaaaagggcaggctaggccaagagtgaggaataaacagtctttattggctttggactaggagtccttgggtcttgagtatctctgtgtatttgtcgatattcttcagattcttctcagcctgtttctgcagcctcataaactgctccttctccctttgcccctccccattctttctcctaatggatcttgaccttctccttcctcttctcctccagaatggctgtcactggttggtacttccaggcaaatttatgaaccaggtgccccaggtaggcaaacttcagtgtgggcttcaggtgcacaaccttgagtagagtagaaatcaccatccacttttgcaaagggcagggcacagggggtgtggatcccatcaaataccttgaggtggtccaggtggccaggcctcacttggttttatggggcaatataccactcatggttcagccaaaagatgcagttaggtgcccgaaagtagaagagacccagaagtggtagggtctaaagacagagttggtgctcctggtcttgtggaaggttagatactgaaacttgttcctgtagaagttgacaaaaatgctgatgtccttgcagtgcaggacctccagcttcctgcccagcagtacttgcttggccattatgaccaccaggcaactcaggagaggcctaggccatcgatcaccagaacctgccccttcaacatcttcaacagccacttggaaaaggccaggaactattttaccaaagggatttaagtctgcactgcagatggcatgaccttgcttcataaccatagagatctgtgttgtgattcttcgaatgggatttgatgtaaacttttttatttttacaaaggcaaggaaattcaaacattgaaatgcttaagaaaataaaaatctttccaaatcctataactggagacaatttgtcgattcatcaatatcctagtgagcattattttaaaccttttactatatatttatacaaatagaactacgtctgtaatttattttttatttattatttactctgtttatagagacagggtcttgctctgtcacccaggcaggagtgccatggcagaatcaaactcactgcagcctccaactcgtgggatcaaatgaccctcccacctcagcctccccagtagctgggactataggcacaccaccacatctggttgttttttgtttgtttgtttgttttttgtagagatggtatcgctgtgtttcccaagctgaccttaaactcctggtgtcaatcctccctcctcagcctcccaaggtgctttggttataggcatgagctactgaacccatccaaattgctgctttttgattaaacactatttttatataacataaattaaccagtttgctatagataattcttaattgagtggtactgccctctagagtatgttttgtgtctcgactatttacatgatgaaatacatattttgttataaattactgcttttttcacattacagttagtatattttgttgtatgtacctatgactttcatttcaggactgtaagggagtgttacaaagtatttattataaaaagggcatgaagtcagctgggattgagaagcactgcttgtagatggacacagagtatcttcaattttcaatactaaaaatattctgatgaacatctttgtatattcatgttttgcagtgggtttgttaggccaaatggtacacatgtgcagaaatttggcacattgtaccaattcacctatataccaacagggcatgagagtgccagtttcctcatatattcaccaacaataatgttgccatggtttggatgtgattattttgccaaaactcatattgaaatttgatccctgatgtggcagcagtattcagaggtgggacctacttggggatgtttgggttacggggacaccactgtcatgaatgccttccggctgcaatgagttcttcctttctcaggaatggattattttacatcagagagagcagcttgctaaatagtgcctgggttccttggattctctctcttgcttcctctctcaccatgtggcctctttgcatacacctcccccaccttccactctctaccatgagtgtaaggaagcagtacaagaccctctctagatatagctgcccaatcttgcactttccagccaccaggatcatgaaccaaacaaatctattttctgtataaattatccagcgtcaggtattccattacagcaacactaagtggactgtgacaaatgtagtcctcttgcatatgccagtcactcttcccttaaaaactagttaagattttcttaaaatttctattctgtgtcttggggtagagtccttcaagtgattctgaaagttccaggattttactttatttctagtaattcctgggtttaatttctgactttaattgatttctcttttccattttttaaaaataacagctatactgggatatacttcatacactacacaattcacatatttaaagtgtacacttcagtggtttttagagacatgcacagagacatgcaactgttactacgatcaattttagaacatgtttttcttttcttttcttttcttttctttttgttttttgagacagggtctcactcatttgcccaggctggagtgcagtggccagtctcggctcactgcaacctccacctcccaggctcaagtgatcctcccacctcaactgcccaagtagctgggactacaggttcacagcaccatgcccagctaatttttgtgtttttggtagagatgaagtttcaccatattgcccaagttggtctccaactcctggcctcaagcaaaccactgacctcaacctcccaaagtgttgggataacaggcgtgggccactgtgccctgccgcaatatttttttcatcaccctctaaaaccccatatacctcagcagtcactccctattttctcataaccccccagtcctaggcaaccactaatctactttttgggtggatttaccctttctggatattatataaaaatagaatagtcaagtatgggggcttttgccactggcttcttttacttagcataatgttttcaggatttattcatcttacagtatgtagtagtacttcttttctattgttgaataatagtctgttgtatatacatatcacattttatttatccactcatcagttaatgaacatttgggttgtatctacattttggctattatgaataatgctgttatgaacattcttgtacaagtttttgtgtagacatatgttttcatttctcttgggtatatatctaggagtgaaatgtcatatggtaactctatgtctaaccttttgaggaactgccaaactgcttttccaaagcagctgcaccatttgacattcccaccagcagtgcatgagagttccagtttcctcatgccctcaacattgcttgcaatagtctgtgttgttggttattgctattctgttgagtgtggattggtatctcattgtggttttaatttgcctttccctgatagctaatgatgctgaacatcttttcatgtgcttgttggtcatttgtgtatcttctttgaatgtcacttagatcatttgcccacttttaattgagctatttggttttttattattgagttgtaataattcttaacatattgtagatacaagtctcttattagatatgtgtttgcaagtattttctcccattctatggattgtcttcattttcttgatggtatcctttgcaacacaaatgtttttaattttcatgatgcccaatttatcctttttttcttcccttgagtgtgctttggtgtcatatctaagaaactattgtctcatctaatgtcacaaagagttatgcctatgttttcttccaagaatttagcagttttagttcatacagttaggcctttgatccattgatttttgcctatgtatatgcataaattttctgtacatgcaattttattattttgcttctggatatgcagttgtaccagcatcatttgctggaaagattatcctttccccattgaattgtcatgacacccttttcaaaaaccaattgaccatgaatttgagagtttatttctagacacttaattctcttccattgatctatatgtctatctttaatgccagtaccttaccattttggctactgtagttttgtagtaaattttggaattgggaagtgtgagtctttcaactttgctcttttttttcaaggttgtttttcctattctaaagcaaattcaaacttattctaaaggaaattcaagagaatttccatataaattttagggtcagcttgtcaatttctgtaaaaaatttaactgggatttttacaacgataggttgaatctgtagatcagttgagaagtattgccattttaacagtattaagtctttcaatccagcacatggaatgccttttcatttatttaattcttctttaatttattttaataatgttttatagtttttaggatataggttttacagttttttggtttaatttattcccaactattttatacgttttgatgctattgcatcagttttcttacttttattttcagattgttcattgcagcatatagaaatataactaattttcatatatcaatcttgtagcctgaaaccttgctgaacttatttattagtttgtaatgatgttttagtggattccttaggattttctatatacaagtttgtgtcatctacaactatagttttacttctttctttccaatctgaatgccttttacttctttttcttgcccaattgccctttctacaacctccaatgcaatgttgaataaaagtggtgagaacagacattcttttcatttattgatcttaggaggaaagctttcagtctttcatcattaattatgttagttgtggcttttcgtagatatctttttttttttcttttttgagacagggtctcactctgtcacttaggccggagtgtagtgagtggtccaatcttggctcacggcagcctcaacctcccgggctcaagcaatcctcctactttagcctctggagtatctgggaccacaggtgtgtgccagcatgcctggtgtttttttttttttttttttttttttttttttgatagagaagaggtctcactatgttgcctaggcttgtcttgaactcctgggctcaagcaatcctcccaccttggcctcttaaagtgtggagattacaggagtgagccaccatgcccacgcctgtaatcttaacactttaggtggttgaggagggagaagtcggaaggagatgcctgatgaaagacatatcttttatcaggttgaagaagttcctttgtattcttagtttgttgaatgttttcatcctgaagggattttgtcaaatgctctttctgcgtgtattgatataattatgtcatttttgttccttatcctaatgatatggtatattaaattaattaattttctaatattagccagcttgcattttagggataaatcctacttagtcatggtgtataattctttttatgtgtttctggattccatttgctagttctcttctgtactttgcaattgattctttgtcaatgtccagatattaggccaaatggggggtatgtccacttcctgatatttccccagataagactgttttggtcatttttcactcattctggtgcctggaaatggaactctttatgagtcttgctagggggaaaagtcaatttcttactgtaagaattaaaacaaatttttattactatatgagtttaatattatttcttactataagaattaaaagctaggcatggtggctcatgcctatagctgggaggccaagatgggcagatcgcttgagcccaggagttcaagaccagcctgggtaacatggtgaaatcctgtctcaaaaaaaaaaaaagaaaagtcaggtgtggtggtttgtgcctgtagtcccagctacagaggaggctgaggaggcaggattacttgagcccaggagttggagcttgtagtgagctgtgatcacaccactgcacggcactccagcctgggcaacacagcaagaacctatctcaaaaaaaaaaaaatagaatttaaaaaaatttacttttgcaatcttccttggtgctagggaagaggcatatgatcattcagacacacgttaattaatatttaatttgggagtgaatgacacctaaagtaaggtctttctctctttctacagcgatactgttagaatagcagaatcaggcttgaggcatgatttagggtgtttttctcagctatttagtctcaaccctagttctctagttctcttagtaattcatggcactgcccagttttttttacttttatttttctttttgatcaccatgaacaaacaatttccttttagtaagtcccgtattgcttaattcagccagggtccacttttattaagagcaactagtagccttgtcagataaaacactcacacatggcattgttgttagttgccttatactaataattcaggagatgatgtcagagattacatcaatgaagaaccatacagaaaataatttaatatcaaatatttgactttcatttttaaaagaatagcattgtccatttctcccaacatggccccagccttccacaaggtgctttactccattctctttacattttcttctcccggctccatccctaaatccttgatcatttcttaagtagaggagtttatcttactcttttttcttgccaatcccaagtaagttttaaagaacttttcacaaataaaagcacctcttttcctaaaacaaaatggttccccttttgtttcattccacctgatatggtttggctctgtggtcccacccaaatctcatctcaaattgtaatcctcacatgtcaagggagggaattgtaatctccacgtgttgaccgagggaggtgattggatcatggggcagtttcccctatgctgttcttgtaatagtgagttctcatgagatctgatcgttttgttttttttttttctttttgagatggagtctcgctctgtgcccaggctggagtgtagtggcacgatctctgctcactgcaagctccgcttcccgggttcacaccattctcctgcctcagcctccggagtagctgggactacaggcgcctgccaccacgactggctaatttttttgtatttttagtagagacggggtttcaccgtgttagccaggatggtctcgatctcctgacctcgtgatcctcctgcctcggcctcccaaagtgctgggattacaggcgtgagccaccgcgcccagccaatgtgatggttttataaggcggttttccctgctgttgctggctttctctcacccgctgctatgtaagatgtgtctcttccccttctgccataattgtaagtttcctgaggcctccccagtcatgcagaactgtgagtcaattaaacctctttcctttataatttacccagtttcgggtatttctttatagcagtgtgtgaacagaccaccacattagaattgcatgttgctttgtcattgccaatctgacaggtaacaaaagatatcacacttatacaaactcacatttgttgcatttattgttgttgttttgggacagagcctcactctgtcacccaagctggagtgcagtggcctgatctcagctcactgcaacctctgctttctgggctcaagcaattctcctgcctcagcctcccgagtagctgggattacaggtgtccaccaccatgcttggctaatttttttttatttttagtatagacggggtttcaccatgttgaccaggctggtttcaaactcctgacctcaggtgatctgcccgcctcagcctcccaaaatgctgggattacaggcatgtgccactgtgcccagcctattgcatatttttaaattagagactaagatttcttcttttctgaattgtctgttattttaactatttttccatgttggaatattagtctttttcttattcttttgtagattcttttaagctcttcatatacagggaatattagtacatagcataaatattgcaaatagttttccaggttgttatttggcatttgacattgtttatgatgaagttttgcttattttcctaaaaaccaaaacagaatttttggttttgtttctaagaaataaaagctttcaagcttttcctttttgacatctagatttcatgtcatctttagaaaagctgcccccactgcctttggcacaaaaatcatataactgtttatgtgtcttttttctccacctgtaattcattaaaaattagaaaactgatgtccagattgataatacgacttgcccaaggtcttacaactaattaaaggaaataggctacagaaaagatggtgctcctactgaaagcagtaatgcataattagtggtacacttcttaattaaaaattttaatgttaagtgagttttttaccctttaaaaattatggctattttctggaagcttttttaggaaataaaaggaaatactctcttaaacagtgataattcaaaagacacattgggacttattacacaaatgaatattcagagtcataattttctttattaaaacatatgggagaccaagcacagtggctcacacctataatcccagcactttgggaggcttaggcaggaggattgcttgaggccaggagttcaagaccaccctgggcaacatagtgggaccctgtctccacaaaaaataaaaatgaaaaaattttattttaatttacttttttttggtttctgtttttgttttgagatggagtctcactttctcacccaggctagggtgcaatggtgcaatcttggctcactgcaacctctacctcccaggttcaagtgatcctcctgctttagcctcccaagtagctgggactataggcatgcaccattacacccaactaatttttgtatttttagtacagacggggtttcaccatgttggtcaggctggtctcgaacccctgaccgcaagtgatctgcctgcctcggcctcccaaagttctgggattacagacgtgagccactgtgcccggcctgatttctagttttatttcattgtggacggaaaagacttgtcatatgatgtctgcttttttcaaattgtgtagacttgtttcattacttgagatatggtctattctgcagaatgttccatgtactgatgaaaagaatgtatattctgcagcagctgggtaaaatgttctgtacatgtcacttaggcactttgatctcatgtgcagtttaatttcaattttttttgttgattttctgtttgtatgatttgaccattactgacaatggggtgttaaaaccccctacaataatattgcagtctatctctccctttatatctattagtgtttgctttatactcttgggggctccattgttgtttgcatacatatttatttatttattttttgagatggagttttgctcttgttgtccaggctggagtacaatggcccgctcctggctcactgcaacctctgcctcctgtgttcaagcaagtctcctgcctcagcctcccaagtagctgggattacagacatgtaccactacacctggctaattttgtacttttagtagaaatggggtttcaccatgttggtcaagctggtctcaaactcctgacctcaggtgatcctactgcctcggcctcccagaatgctaggattacagccgtgagccactgcatccagctgggtgcatacatatttataactgctagttcctcttgctgtattgaccccattattattatatagtgatcttctttgtctctttttacagtctttcacgtgtagtctattttatctgacataaatatagctactcctgctttttcttggtttcctgttgcatagaatatctttttctatcctttcaccttcagtttatgtgtgtccttataggtgaagtgggtttcttgcaggtaggatagagttgggtcttgtttcttcatccattcagcaactgtatgccttttaattggagatttaagtccattttacattgtgttattatggataagtaaggacttactattgccatttgttgcttgttttctgattgttttgtaacgcctctttttccttcttcctttcttgctcccttcttttgtgggtaagtgattttctctggtagtatgttttaactctttgcttttaatttttagtgaatctattaaaggtttttgtattgtggttaccatgaggcttacaaaaaacatcttacagatataacaagttgtttaaaaaagacagcttatcttagatcaaaaatacaataatagaaacaatcaaatataaaaaatgaaagcaatacactttagctccttgtatcccgcattttgactttttgttgtctcaatttacataatttatatataataattatattacattatatattatgtaacatataatatatatcattatgcatattatatataattatttttacaaatttttacctcaagtacattttttatattacctatctcttaacaggttgttatgccttttttaaaaaattagatttgcatttcagtatctttgtactagagttgtgagtggattgattgcacacataattacagtattagagtattatgggtttgtctatatgcttaatttttaccttggattttataccttcaaataatttttttttgcatgttagtgtttttcttttcctttcagactgaataattccctataatagttcttgtaagatgggtctggtggtgttaaattttctcaccttttgtgagaaggactttatgcctccttcatatttgaaggatagcttttctggatacagtatactttgatagcagtttttagaattttggcactttcaacttaccattctgctttctcctggcctatatgttctccatagagaagaccgttgccaaacaaattggagctcctttatatgttgattcttttattttgccacctttggctcctctctttgtccttgacctttgagagtttgattattagatgccttggggtagtcttatttggctcaaatctgtttggtgttctctgaccttctggtaccttgatatttatctctttctcaaggtgtggagagttttctgttattatttctttcaataagttttctaaccctgctgttgctcaactccatcttgaacaccagtgattcttacatttggtctttggagataattttccatatcttgaaggcaatctttgttcctttgtattctttttcattatttctacttagacaatgtattttcaaatatcctgtcttcaagttcactgattcttttaaaattgtgtttattttttatttcaatagcttttaaggtacaagtcatttttggttacatggatgaattctatagtagtgacttctgagattttagtacactcatcacctgagcagtgtatgctgtacccaataggtagtcttttatcgctcccccctccccactgagtccccaaagtccattatatcactttgtatgtctttgcgtcctcatagcttagctcccatgtataagtgagaacatacggtatttggttttccatttttgattacttcacttagcataatggcctccagcttcatcccacttgctgcaaaagttactgcagaagacattatttcattctttttttttttttttttttcaagacagagtttcgctctgtcacccaggctggagtgcagtggcacaatctctgctgactgcaagctccgcctcctgggttcacaccattctcctgcctcagcctcccgagtagctgggactacaggtgcccaccagcgcgtgcggctaattttttgtatttttagtagagacggggtttcaccatgttagccaggatggtctcgatctcctgacctcctgatccacctgcctcggcctcccaaagtgctgggattacaggcgtgagccacagtgcctggccttatttcattcttttttatggctgagtagtattccatgatatatatatatatatgtgtatatatatatatatatatatatatatgtgtgtgtatatatatatatatatatgtgtatatatatatatatatatatgtatatatataccacattctctctgtctactcattggtgtcaatgggcacttaggttggttccatatcttttcaattgtgaattgtgctgctattaacatacttgtgcatgtgtctttttcatataatcttctttacttttgggtaggtacccagtagtgggattgctagatcgaatgatagatctacttttagctcttcaagggatctctatgctgtttcccacagaggttgtactaatttatattcctaccagcagtgtaaaagtgttcccttttcaacacatctacaccaacatctattgttttttgactgttttatcatggccactcttgcaggagtaaggtggtatctcattgtggttttaatttgcattttcatgatggttactgatgtagataattttttcatacatttttgggctatttgtatatctttttttgagaaatgtctattcgtgtcttttgcccactttttgatggattttttttctaattcatttgagttccttatagattctgcatactagccctttctcagatgcatagtttgcaaatattttctccttttctgtggattgtctgtttactctgatgactatctcttttgctgggtagaaacttttttgtttaattaggtcctattcacttatttttgttattgttgcatttgcttttggggtcttggtcatgaattcttttcctaggccaatgcccagaagtgtttgtccagtattatcttttagaatttttattgtttcaggtttaagacttaagtctttgatcagttttgagttgatttttgtataaggtgagagatgggaatccagtttcattcttctacatgtggcttgccagatttcctagcaccatttattaaatgggatgtcctttccccaatttatgcttttgtatgctttgtcaaagatcatttggttgtaaatatttggctttatttctgggttctctattctgttccattggtctacatgcctatttttatatcagtaccatgctgttttgataactatagccttctagtatagtttgaggttgggtaatatgaacaaatccagatttgttcttcttccttatggtttctttggctatgtgggctctttttcagttccatatgaattttagaattgtttattctagttctgtataatttgaagtccagtaatgtgatgcctccagctttgttctttttgcttactggggctatttgggctcttttttgattccacatgaagttttggattgctttttattgttctgtgaaaaatgatgatggtattttgatggaaattgcattaaatctatagattactttgggcagttatagttattttcatactattgattcttttatcatcatgggatgtgtttccattcatttgtgtcatttatgatttctttcagtagtgttttgtggttttctttgtagatatctttcaactccttggttaaggatatttctaggtattttaattttattattatttttgcagccattgtaaaagggattgagttcttaattttattctcagcttggccattgttggtgtatagcaggacaactgatttgtgtacattgattccgtaaccttagactttgctgaatttatttattaggcctagtaatcttttggatgagggatgagtctttagggttttctaggtatacaatcatattgagaggtgacagcgtgctggcagtcctcacagccttcgctcactctcagcgcctcctctgcctgggctcccactttggcggcacttgaggagcccttcagcccactgctgcaccgtgggagtccctttctgggctggccaaggccggagccggctccctcagcttgcagggaggtgtggagggagaggcgccagcgggaacaggggctgcgcgggtgtttgcgggccagctggagttccgggtgggcgtgggcttggccggtccgcactcggagcagcgggctggccctgccgccctgggcaatgaggggcttagcacctggtccagcggctgcggagggtgtactgggtccccgagcagtgccagctcacccggtgctgcgctcgatttctcaccaggccttagctgccttcctgcggggcagggctcgggacctgcagcccgccatgcctgagcctcccacccctccctgggctcttgtgcggccggagcctccccaatgagcgccacccactgcgccacggcgcccagtcccatcgaccacccaggggctgaggagtgcaggcgcacggcgcgggactggcaggcagctccacctgcagcccccgtgcgggatccactaggtgaagccagctgggctcctgagtctggtggggaagtggagaacctttatgtctagctcagggattgtaaatacaccagtcggcactctgtatctagctcaaggtttgtaaacacaccagtcagcaccctgtgtctagctcagggtttgtgaatgcaccagtggacattctgtatccagctactctggtggggccttggagaacctttatgtctagctcagggattgtaaatacaccaatcggcactctgtatctagctcaaggtttgtaaacacaccaatcagcaccctgtgtctagctcagggtttgtgaatgcaccaattgacactctgtatctagctactctggtggggccttggagaacctttacgtccacactctgtatctagctaatctggtggggacctgcagaacctttgtgtctagctcagggattgtaaacacaccaatcagcgccctgtcaaaacagaccacttggctctaccagtcagcaggatgtgggtggggccagataagagaataaaagcaggctgcaagccagcagcggcaacccgttggggtcccttccacactgtggaagctttgttctctcactctttgcaatatatctagctactgctcactctttgggtccacactgcttttatgagctgtaacactcaccggggaggtctgcagcttcactcctgagccagtgagaccacgaacccaccaaaaggaagaaactccgaacacatccgaacatcagaaggaacaaactccagacgcgccaccttaagagctgtaacactcactgcgagggtccacggcttcattcttgaagtcagtgagaccaagaacccaccaattccagacacaatatcatcggcaaacaatgctagtttgatttcctcttttccaatttggatgtactttatttctctctcttgcctggttgctctggctaggacttcccgtgctatgctgaatagaagtggtaaaaatgggcatccttgtcttgttccagttctcggaggaaatgttttccacttttcctgattcagtataatgttggctgtgggtttgtcatatatggcttttattattttgaggtaaatcccttctgtgcctagtttattgagagtttttaatcataagcaatgctggattttatcaaatgtgttttctgcatctattgagatgatcatatgttttttgtttttaattctgtttatgtgatctatcatatttactgacttgcatatattcaatcatctctgcctcgatgggatgaaacccacttgatcatgataaattttctttttgatatgctgttggatttggttagctggagtttgttgaggattttttcatctatgttcatcagggatattggtctgtagttttcttattttaatacctttcctggttttggaattggtgatatggacttcatagaatcatttatggaggattccctctttctcttttatttgtttatttggcatgtgtctcaagatattaccccttttctcaatctttttgaatagtttaagtaaaattggtaccatttctttctttgaatgtctggtagaattcagctgtgaatctggtcctcggctttttttgttgttgttggcaattttttttttttattattgattccatctttctgcttgttatttgtctgtttaggatttctatttctttctgatttaatctaggagggttgtatgtttccaggagtttatccgtttcctctagattttctaacttgtgcacataaacgtgttcagagttgtcttgaattatcttctgtatttctgtagtatcagttgtaatgtctctggtttcatttccagttgagcttatttagatcttctctctattttcttgattaatcttgctaagttctatcaattttatcttttcaaagcaccagctttttgttgcatttatcttttgtatttttggtctcaatttcatttatttcttctctgatttttgttatttcttttcttctgctggctttaggtttagtttattcctgtttctttggttttttgagatgtgaacttaggttgtcactttgtgctctttcaggctttttgatgtcggtatttaatgctatgaactttcttcttagcattgcttttgcttttgctgtatctcagggattttgataacttgtttcactaccatcattcatttcaaataattttaaaatttccatcttgattttattgttaacccaaaaatcattcagaaccagattaattaatttttatgtatttgtatagtgttgaggattcttttgtcattgagttgtagttttgttatactttggtctgaaagatatttgagatgatttttattttcttaaatttattgagacttgttttgtgacctattacatggtctatcttggaaaattttccatgtgctgatgagaagaatgtgtattctgcagttcttgggtagaatgttctgtaaatatctgttaagtctatttgttctagaatgtagtttcagtccattgtttctgtgtttactttctgtctcagtgatctttctagtcctgtcagtggagtatttaagtcccccactaatattgtgttgctgtcaacctcattttttagatctagtagtaattgttttataattttggaagctccaatgctaggtgcatataaattcaggattgtaatcttgttggattggtcttttaaccattatataatgaccttttttctttttgctgttgttgctttaaagtctgtttggtctgatataagaatagctcctcctgctcgccttttgtttccatttgcatggaatatcttttccacccctttaccttgagtttgtaagagtccttatatgttaggtgagtctcttgaagacagcagatatatggttttttattttttttatctactctatcatccagtatcttttaatcggaatacttaggccacttacattcaacattaatactgagatatgagatacggttccattcatcatgttagaattacctagatacttttttgttgtgttatggttttataggccctgttttatgctttcaagaggttctatttggatgcatattaagcttttgtttcaagatttagaactccttttaacatttcttgtagtgctggtttggtagtggcaaattccctcagcatttacttgtctgaaaataatttcatttcttcttcatttatgaaatttagttttgctggatacaaaatttgtggctgacagttattctttttaaggaggctaaatgtaagactccaatctcttctagtttgtaaggtttttgctaagaagtcttctgttaatttgaaagttacttgctgcttttgtctcacagctcttggcattctttcctttttgttgactttaggtggcctgatggtcatgttccttggtgtaatctttttacagtgaatttctcagttgtttgtttgtttgtttgtttttgaggttcttgtatttggaaatttaaatctttagcaaggccagggatgtttttctcaattattttctcaaataagtttttcaaacttttagccttctcttttcctgcagaaacaccaattattcttagctttggccattttacataatcctgtatttcttagagactgtgttcatttctttttattctttttcctttatctttttctgactgagttaattcaaaagccttgtctttgagctctgaaattctttcttctacttgttctaatctattgtttaaactttccactgcattttatatttctctaagtgtgtctttcatttccagaagttctgactggtttttctttatgatatgtatctctctaagacacttttcattcatatcctctttttttttttttgagacacggtctcactctgtcactcaggctggagtgcagtggtatgatcacagctcactgcagcctcgactacccaggctcaattgatccttcgatctctcagcctcttgagtagctgggactacaggcatgtgccaccacacccaactaatttttatattttttgcagagatggagtttcacaatgttgtccaggctagtgttgaactcctgagctcaagcaatccacccgccttggcctcccaaaatgctatgattacaggtgtgaaccactgtgcctggcctatatcctgaattgtttttaaaatttctttatggtggttttcacctttctgtggtatctcttcaagtagcttaataaccttctgaatctttatttggtatttcaaagatttcatcttggtttggatccattgctggggagctagtgtgatctgttatagaactctggttttttttgtgtgtgtgtcaccaaaattaacttttctggttccttctcattagggtagactatttctgttaagtattcttgaatttaagatttcttttctttctttctttctacccttaaggatgtgactttaatgtgtgtagtttattatagcctaatttggttggtcgtgcttttagggtgatgactctgtatgagttccttggttatggagagtgtttgtatgatagcttcctcagatactggttgtagaagctacgtacttggtgtgtggataagttcactatctcctatggggttggaatgacagaggtcttttgaagcttatcccatttccgtgtggtgtgcacttatttatttatttatttatttatttatttatttatttattccccagtattctatttactgagttgatgattcaggtctcaggtgagtagggaagattttcctcggtagaaactggttgtagctaaagcaggtgggtaagtgcaatggccagtggcgggcagagatcccagccttgatgatggtagctgggggagctctcaattagatgcactgaggtcttaacaggggaaagggtaggagccaccccagctccccctgccaggccagcaggaaagctgtccacctcccagactcactcctgtcccaatgtttcagctattcagattagacaggcaccccttttcttctgcatgaatgttgatgttccacatagagaagaactgtgactctgcctctcatggaagcctgaacctggaaggtgctcctcctgtggagatgcagtcaccctgcaatgttccaggaaggatgtctgtagatgcacccatgctgagctaccatgggagaagcctcagctgtgtctgtagtggtggacaaggagagaaagaagaccccttcttcaagacccttcatgagcaccaaggctgcctgactgttgggatagtactgcagactttccctgctgagcccagcactgcaattgcatctctacagaaagaaacttcccaccagagtgaagatctggaactcaaagcttgctgtccagattcttttgtcctatgaggtgttcctttcatgtagtgttctccctcttcccctaggagtaggagtttctgagagccagactgcagtgattgctattgctcttctgggtctagccacctgtgaggctgccatactccaggttggtgccaggaaatgtctgcaagcgatctggtgatgtgacctgtcctcaagtctcctagcagtgggtaccagcaccagctctgatgagggtggcaggggagtaacgtaaactctgtgagattccttggttatagatagccttagcgtgctgtctttctcaaatgctggttacaatagtagtaaactggtcatgtggacagactcaggacctcttgttgacaatggtgatagctgaggtcacacactggttttcttcttcctgggtggtatgttagtgtgcctgcagatgctgtaatggactgtcagttaccctccagccagcaggtggtgcctgcaaaagagcagcagcttcagtagtaactgtgggatttgagcttgccttatgttgcccaggggaggtattttggtttctcaggtgatgggtgaggacataaagttccccaaaatttctgtcctttgtgttaagctaccagggtgtgtggagggccataaccgggtggggtctgagtcaggtgggtctgcattctgactccctgtgtgtggggcaagctgtgacccctgttggggtaggaaggtcattcttaagcctctgaggtaatgttccataggtgagtgtaactgctctgctgttcagaagaacttgtacaagaggtggggagtaacatgtggcagtaagcctcacttagatcccacacagttggccaggctgatctcactcccacagtgccctgctagtagcactgggctaagtttcaggtagcctgcactcagaactcaaaccttcctcaggccataaactttccccatgaggataacaaccacagctttcaggccacatccttccccatccacctgcaaggatgggtgcctggctcctgtgctcacaaatatagcatactttccacttgccgtccccacccctccagggttctgaccaagagaatttgtccctacttgatgttatattgtgaaattcagttgggagttgtgactactgtctgagctggttggttgactttgctgaggttcctgtgagatataataaggaatggcttcccttggtctgcactggagattgggaatgcctgcaaggcacttcccactgctgcttctacttttatatttcactgctccctaaatcagttcctgttctgtgttggattaaggccttcacctgtggcctggatttttaagttccttaatggggatatgtatcctggaggcagtctctcccactctaacactctggggacttagtttttggcctgtttcatggtgtaggctgaagcctgccacttctttcaaagagtctgtggattctttcacttttcctgttaagttcctgtattgcttcttggaaaaaagttcacaatgtgaatctctacacctattttgtccttccaagtggagaggcatgctgacattgcctccaattccccatcttgtgggggagaggggaagctcactgattctttcctctgcatgatccattctgctattgaggaccccctaatgaattttttagttcagccaatgtatttctcagttccaagatttctgtttgatttcattatttcaatctctttgttagattttttgataagattctgaattgcttttctgtgttatcttggaggtcattgaattatcttaaaactgtgccttggtgtgtgtgtgtgtgtgtgtgtgtgtgtgtgtgtgtgtgtttggagacagggtctcactctgtcacccagactggagtgcagtggcctgaacctgacctactgcagccttgacctcctgggcttaagcgatcctcctgcctcattatcctgagtacctgcaactatcaccatgcacgtatcaccatgcctggctaatttttaaattttttttgtagagatgaggtcttgctatgttgcccaggctggtcttaaactcctgggctcaactgaccctcctactttggcctcccaaagtgctaggattgcaggtgtgagtcaacacacccagcaatttgctattttgaattcttggtcagagagcttacatattgccatctctttagggtccgtcactggtttcttgcttcattagtttgtggaggtcttgattccctgtttgctgttgtttattgatgatgtgaatctatgtctttgcactgattatttatttttccagtcttctttgactagcttgttttttttttaattggatatttttcttagactttttttttttttggtaattttcctgttgaatttctattttttttttttttttttaagatggagtctcgctctgtcacccaggctggagtgcagtggcgtgatctcagctcactgcaagctccgcctgctgggttgatgccattctcctgcctcagcctcccaagtagctgggactataggtgcccgccaccatgcccggctatttttttttgtatttttagtagaaatggggtttcaccatgttagccaggatggtctcgatctcctgacctcatgatctgcccgccttggcctcccaaagtgctgggattacaagcatgagccactgcacctggccttcctgttgaatttctttcttttttttcccactagattgctgtgtccatttagcactagatagtattttaagcccaggtttgtttcaggtctagaaaaggatcagagtgctgcctgtcccaaatggagaatgccccaaaagtacatcccagcagtatgggaaggctggttaggggttcatgtccaggagacctatggaacacttttcctacagcatggtgctgctgaacattcactctggtttagtatcatctttggctgagttacagagcagtttccagggtaggggatggcagtcccaccatctccctttgtctctggctgtccacagggctatttctcccattaggcattcacaatgcttcctgtgggttggggcagggacatgtcttctgtcatggaactcaacatagtggggaagctgattattcatcttgatctcactttttccagtgtaaaaattgtgagttgaggagaaattttctgcatgtttggtttggggcaaattgagggaaggggtgttatggacatggaagtctgattttcttatcatctactcagaggtttttcacttccctgtgaccccaggaactgctttatcttcatttttgagttctgggatattgctggtgataatctcagcactgtatgccacttttggaactggaagcccctttctgtctcagattgtctttatctctttttcattcttgaaggatagtgttgccatgtatattattatttgattgtttgtttgttttttcccacagcactttgaatatatatcatcccatgccattcagacctgcaagatttctgctaaaaactagtgatagtctcatgaggattccctcatatgtgacatgttgtttttctcttggtgttttttcaaaaatctttctttgtctttgacaatttaattataatatttctcagtgtggatttttagggttcatcttaagttgggttctgtaagtttcctgcatctaaatgtccatttcctttctcacatttgatactttttcagccattatttcttagaataagctttctgcttattttttctctcgctgtctctcttcctcttctgagacttctataatgcttgtattggtctttcttaatggtgtgctgtatatcccttaagctatctttgctgtttttcttttactcctctgatgaataattccatgtgatctttctccaagttctctcattttttcttctgtttgctttactcatacattttacccctcttttgattttttcagttcagctattggtattcttcagctccatgatttgtttggtcctttttaaaattttctctcttagttgaaattatccttttgtttttacattgctcccccaagctcatgaagtattttttgtgacacttattttgatttttctctgaagtaatttatatattcccatttcattaggatcagtttctggagtttaatctttttcttttgtttggataatgtttctttgtttcttaattttccttgattcttcctgttgatatctatgcattagaaaaaactttaccatctcccagtctttctggatttgtcttgtacaggagaagagcttcaccaatcaacctggcccaaacttttgtgggcctctcaaaccttcatgctagttcaaacttctgtctttgttcttagtggcttccagacctttagagtatgccaggttctgtcaacattcttagatagctggaaaagaagccaagtcatcaggtagctcctatagaagttggaagtctaggtgcatggtccaactctttccctctccagggataagctggttgctgaggtttttggggtttttgtttttttatccacttgctctgaattgagccatagagaggagttgtgctgactgcctggatactagttcaaaccactgctttgttctctgtcacttctagaagacagtgtatgccaggccatgtcaactttctaagacaggaagatggaagccagctcctcaggtagcacctaaataatttggggc

SEQ ID NO: 672 - DNA, 9119 bp, Homo sapiens
agaagcacactgaaacctatccaaaagcatcccaggagggcacactgagtgccgcatggagcctgcaccaccatggggaggaagcagccaccgccttcctgaatccccaccaggcagaaacatctctcccgtctttgaacttcaccacgccgtgcatcttcctctgggtgtgcaatcgtcacctgcgtacatgattgattctgcccccaacactagactcaggcagaaagaactcaaagctcagatggtcagggtcctgttggttcatcaagctcagcctgcctggaggcagccactgtgttgttccctctcttcgtcctccctctgcactctctcttgccacgggacatttgcacaagcagttccctctaactggaacactaagaaatatggaagtaaaaggggttgggagaaaagacaggagtcacaggtgactgtgtgggatgaggagagtcgtgaaaactttttttttttttttttgagatggagtctcgctttgtcacccaggctggagtgccagtggtgccaatctcggctcaccgcaacttccacctcccaggttcaagcagttctcctgcctcagcctcctgagtagctgggattacagttgcctgccaccacgcctggctaatatttgtattcttagtagagaagaggtttcaccatgttggccaggctggtctcaaactcctgacctcaggtgatccacctgcctcagcctcccaaagtgctgggattacaggcatgagccactgcacccggccgaaaacattaagagtaggtggatgttactttggacaccaaatgaagaagtgtgccgagctgaaagagaaaaggagaagaaaatggacatgacatttacggggttcctcttgcagagagagaaccgtgtagaaggtaagctctcactactgagttcaagtcccagacataatacttgctggctgtgtggccttgggaaggcccatgagcactctcagtgaaagtgaaactgggaagtttctgctttggagagattttctcacaaatgagatgagttatcatataccaagcccttagagcacggcctggctcacaggaagccaacagtaagtgtgggtcattatcagcgctgttgttaactgggggtaataacaggggccaggggccaagaggctttatctagccctatttcagaggcaaagaaatgagggtgaaaaagttcaggggcctgcctgcagtcacacagcagagccagatatgaacatcgacgttttggctttcaaggtccacacccgccgtatcctactgcacggtgctggaaggcacatggaagactattgcagcccaatcttctcatgacaaagacaggaaaatggagccctctaagagaaagtgactgatccacccttatgctcttaaatggtaagcgtccagggatcatccaagttaagatggcccacacgcagctggcaaggcaggacccgaggctgaatgagacgtacaattggctccacggtactggcagaacccacagctagttttcaatgctgagaactgtccatcctggcagaggctcactgccctctgtgccctccctggttgcctgggcagatggtgagctctggttgccaaggagcccgcgttggcagttctgaaatggggtgcgtcagcagcctcgctccagcggcttcccacatccttgagtaaccaccacacaaaggtgctgggcatgagaccaagggtgcggcggagatcgaattagtaatacacactcggtgaccctccccagccaggtttcactgcgtgcttatgaccaacattcatcccttccttagcatctgtggtgtctttaagggccaagtaaaaaggtaaaactgcagggagtcaggagggggaaactggcctggggtacagagtccctcacaatgaaaatatatgtaactggctacttgtaggtcatgatgcattaagtgatcctgtcaaaagttgaaagtgggctacagtgggacaggcaatgcccagagggaggcagaaaggtgtaaataatccgaggtgaatgtgggtcttgttggcatggtagatttatgccctgccttcataatgtaccctttcatcttgggagcctggattccaaaaatctagtctagacaggaattgatggtgctacctctcagcttacatcgttcaaggtttctcaacaccaaagactcctgaatattgatgggaacaacccacttagccaggggatattgctcagaactcaggaggccaaaggcatcattcttccaggcacggaggccctgctcagaaacagccctacagaggcagagtcactcattctgggggatgacgctgccttttgtcttcatctccccaagtgggagacaagtcccatcacgcctgccacctggcagtcagccttgcgccttctctttcgtccttttcatgtgtgctccgtgccggtttcagcagctttcatcagagactgaaactaccaccactcccatcacctcccagggccatgggcaggccctggctgacagatccaggcctaggagcctgggcaacgataaataggtggttgggaggacctctccgagcccccttctctgcccaggcaggctttctccttgggtggccagagccagggcccaggatcccctgctgcaagaactgagaggctgaggggcttcactcctgaggaaggtcctctcttcctaatccccgtgctttgggcccagcaaattcagcctgggaactgggggctgctgtggaagagagatggagctagggagcatttatagtgcagcacctgaggctgagcagtgacagagctgcgggcctgagaattacaaaacagacttaaacagatgaaatattgcccaggcatggtggctcttgcctgtaatcctagcactttgggaggccgaggcaggcggatcacttgaggtcaggagtttgagaccagcctggccaacatggtgaaaccccatctctactaaatattagctgggtgtggtggtgggcacctgtaatcccagctacttgggaggctgaggcaggagaattgcttgaacccgggtggcagaggttgcagtgatctgagatcgtgccactgcactccagcctgggtgacagagccagactctgtctaaaaaaaaaaaaacaaaacaaaacaacaacaacaacaaaaacccatgaaatattaactgatgcagggaaaacagacaaaaactatacatgctcaaaacaaaacgaaaaagggcacagggctcagaaaccagtttgtcgtctttgtgaacagctgggaactctgactcatgcactgtcccctgttctctatgccacaggaatgaggcagcaagaggccagattctgccggagacagagcagagagccaaaccatcgccacttattggtgcatgaacctgggcaaggcaggggtatccctgagcctcagcttccttgtttgcaaaatggtgacatgcctacttccagagctgttgttaaggttaaatgatgacgcagtttaccatatgccaggcacatagtaggcactaaatagttgcaattattagccctgagcaaacattgctcagccattcccttgtaaagcctattctcaaaccaactttccatgtggacgttcaatcatctttctggatgacctcgccttacccattgcctcagattctgtgtgtgtgtgtgtatagaagaaacaaagaaaaaaagtgcttttcacatagtgaggacatttccccatcctatgagtctgtgtatgtgtgtgcatatgtatatgtatgtacacacacacacacacacacacacacacacacacacacactgccccgtggaataggcaggacggggttgcatttcccctcttttaaaggtgaggatgctgagcctcagaaagatcaagtgacctgaacaaagtcacacagccaatgtgtttctccaaaagaaatgaccaggagtcagtgtttctttatacaagggtgtccaatcttttggcttctcggccacactggaagaagaagaattgtcttgggccacacataaagtacactagcactaatgatagctgatgagctaaaaaaataaaaataaaaatcacacacaaaaaacagtgttttaagaaagtttacaaatttgtattgggctacattcaaagccgtcctgggccatgggttggacaagcttgctccaccataaacacgtgatgaacagacattgaaatcgtacctttagggctgttttaggaacacaagaggcatcatctggctatcttgagaaagcagatttcaattttctattcattaaagaaatgtgcttccatctaccttgaaatcattttgatgatttccagattcaagtccctgaataaattccagggaaagtcacgtcacgggacagaatggccgtcaccttgaaaaaaaattattttctcctggaggcactactgaggctcagcgatcccacgtctgccactccctcctactgcatgtggtatccctgagtctccgctcagggaaaacagacaaaactacacatgctcaaaacagaacaaaaatgggaacagggctcagaaaccagtttgtctggttccagtcatttccaccgcaatgacagatccagtgaccttggcagccctcatccattcaccacatcttcccattaccacctaacgtgcccctcccaatagctccgtgtggtagaggctgcacacaggctcaggattcccacttcacaggtgataatgtcaaggtgcagtgacatgcagcttcttgtcccaggtcaggtgtctcatgattgttgagccactgtcttctgactcagccagtgatctttcctttggaccacaacccctctgaaaagcactgtgctgagaaacatgggtttactttacctattgctattttgtacgtttgaaacgatctttccaaaacagatttaataattgaaagttttgctctctgttccttggagaaaagggacatgctttgaggaaggaattggaacccgaacagtcatgttttataggcattcatgtttatttctctgatattatggcttcctctggaaaaatccaaccaacacatccgtttcaagtcttgagaaactcccaaatgttgaccatgtgtctgattcctgtgtggtcaaaagagtgatgtttcttaatgtccacaacttatttccatgttaaaataattccacgctcagctaaatcccacttacacacaagtgtgcacctgttaaaataggtcatttttcactgctaatcttccagattccatgagtatgtgtgggaaccccagacaaatgcaacttgaatgtcacaaaaggcatttttctttgctgagtgaccctggttggcccagacaccctgggtgccttgctcccacagatttgtaaaactaaggaagatccctttctgctgagagaatggattggaattaaatcttagcatagaaggccttgggtgaaactgtatggaattttgtcttacaactgggttattttttaattagatttttgtcgatcttttttcaactctgaagtatgtcagtatggaaactcagtaacttttctcaatgctccccataaagctaaaaattaaaaagaagagaagagaaataaaaagggaaaaaattaaaatttcagagcaagaagctctagcctctgagattttgttactgttgcaaaagtaataggtcatctttgccacaacctcaatgctaaaaagtagatgcacaaaaaagcaatttttatcccaaagtcttcttggcgatgagattttttttcctgcttcagatttggcatgcttccagaaacccaagggccctaaatcaatatcaagtgaccgcttccaactcgtaagagcctctagggctcattgcaaatgtgggctctgggttccagagagacaggcttaaagaaattgatggcaaaaatgggaagctctgtggctgacctcagttgcaggatccgtgctgggacagcctgtcctccgctccatgatttgtgagggcctgcctggtattgctaatcttcctgacagtttagtttgaagagaaaaggggccagtggcactgtaggcaacatcagacaagccacagatctcctgggagatctaagctctccaggaggcagataacaacattttgcctttccacggggttgttaatatacatatgaatcccaaatacaagaatgggctcttcaaactggtttatttaaacactttttctgagacacacgtttcaagaaggggataaagagggtgtgatgtggatcctgtgctgtcttcaaagaagggaaggtggactgctatgtttctagtgtagaatctggcacagaaaccacccatagcaggtgcgccacggacctgctttagctggaaggatcctttctacattccttccaccacctagtgagtggccacgttgatgatgagacctgggcctttaaaaatcctctttcaggtctccagccaaccctctccattcaactcagtttcacaaaccttttcttagcagccacccattcccaaggactgtagtgggtgccgcaggggagacagaggtgaaggagacacagtcctttctgctgattctgcggctgagtcagctgatagcctacgtctatttgccaagaatatgatcaactgagtgaaaacaacaaaataaaaaacgctgagttggggagatgactcgactcgggaggataatgagaatgtccaagctgtgagtcccctggaggccaaggcaagtttgcagctggcatggtaacagcagggtggttgctgagggaaactgaaaccatgtcacatggaaaagatttgtaggagtggagggcctttggcctggagaagaaaagccttggagaacagaaaggctggtttcacatacctgagagactgccatggggaagacccatactttgttctctggggccccagagggggcccaccatagaacaggactatggtggggatacgtagggggaccgattgcagctcgaaattgcgaagtcctgtccttgtcagagctgtcccaggtggagtgggatgtaccaggaggtggtgagttcctgtcattgcagggatttcagtcggggtggagagcccactaaacaaagacgctgtggagaagaaccaagcatggaggagggtggagggcctgatcttctaagcttcactctctgcctgggagtcttcgattcctccctcctcttactataacttaatgagctgctaacgccaacacctggcttcttattcaaacatgcttaaatgtgaacggggaagactggcatcagaggtgggcagattaacaacaaactccctcaggggtctccaaaatgagagagaagggacaaaggcagaatcgttctgcgtgcctgcaagttggatttggagtctccacactgtgcctctggccgttgaacagaagaggggtctctttgctgtgtctttagcaaggtgacaagcaagagagctgggtagcacagcctggggctcacaggcagcagatcaccttcagctccccaggcccctctgtcatggactcaggccactgctgggactcagtcaccaggacagggagagcccagagggcactgctccacagggtgggcacagcaaacagcccttccccacactcccactcttcccggcagagagggtgcctgcggtgtgactcgagggaactcggcctattcatctcacccgcttctgcctatctctccacacacacttttgtcattgttaaaaccatgagcagctttttcctgatatcacagtctaggaaatcgatgcctcgttcagtgagccagcacttgctgtgctcttgccacaggttgggactgtgtggatggatgccccattgcttagggagcacagaggagggacctagctcgggctggggctttacagaaggcttccgagaagggatgtcattggcctgactcttaagaggaaggaaaagaagagcaccaagtacaaatgattagcactactcatcagcaaatcaggagactgggcgtgtagggagatgaggctgaggaagtcactctgaacacacacgaggggcctgattgtcacctgaaatgcctgatgttttcctgttggttatgggaaacagagggatgacatagattgatttatagagatttttctgcctgcatcaaaggcatcataaacaagagggtaggactagtggcaaagaaacgagtcagaattgtttagtcgagacatgagaagaccctgagctagctcagtggtagcagggtggaaaggaagggaccaaaaggagaaatattttggatttaaaaattaacaagactgtccaacaaatagaagatacagagacaaatgattcaataaggcaagggtcaaaagacttgaacaggcacttcacaaaagaagataatgcccaattaagcacatgaaagagtgttcaacattaaatatcagggaaatgcgagttaaaactacagtaagacagcagttcataccccttagaatggctaaaatcaaaacaaatgatcataccaagtgctggtgggaatgtgaggaacctggaactctcatgcactgctggtgggagaggccaatggcagaaactctttgaaggactctgagagtgtcttataagtgtacatctaccctataagcaagcaattccactgctaggtatttgcccaagaaaactatgtttatacagacttgtataagaaaaatatgttcccaataaaattgtaaagaatgtttatggcagtcttattcaaatattgaagaactggcagcaacccagatgtccaccaggaagtacatggataaacaacctatggtatgtccatataatggaatatcactaagcaatagaaaggaacaaactatttatatattcagtgtaacatggatgactggcaaaaccattatgggaagtgaaggaaaccagacccagaatagtacacactgtatgattccatttacatgaaatccaaatgtagacaaacgaatatataatgttagacaccagtttgtgggtttatgtaagtgttttggggtgttaggtggggggttgttgaccagttagaggcatgagggaacttcctcaaagaatagaaatgtc

SEQ ID NO: 673 - DNA, 3929 bp, Homo sapiens
gtcttctgacacaggcatctcacaacaccagtgcagccggaccgttgtctgatcaaagaaactctagtaacgtggaaattcatgctccgagtagtgacaagccagtgactttttctatagaaagggtacaagactccaatttgaaaatctcaagcagctttatattcaagcaagttcaatccaatctcttcctgactcactgtctcatcaacatgcaaagctctcgaagagaaatcatctcttacttgcctgagggagttctggcagacgttttgaatgtggatgtggaagttctttcctcgtctccatcctgtcaagagccgtggagcaaacagcaggatgaggaagacatggaagacaaaactgataacgcacgtcacctcgctgcagcgggagacagaatgtaacttcaattcagcctctttggggtttgggttctgaccaagtaaatcgggaatgttgttaacatatcaagccagcctttattgtttgtcttaacccaagaaaacacaaaatgacacttactttgttgctcatttaggttttaacttgttgatgtcctccccacaaaaatcaaacttgaaaatgcctggcagggacccctgagatctagggtttgaaatgctcttttgacaagttaagaggttaaaaagaattcaggaacatactgtagagtctcatgggggattttagaaaaaaaatatgcaaagcatctttaaatatgtggaaaatccttaggagtgaaattgcactgaagtcagattgttttcctattgaggttgcattgctcggctgcaagaggtggggtgggcacatcgtggggggagagcagaagtgcctgttagggtgctgccagacctcagtgtggaattctgcttctcacagttggccataatcaatcaatcagactctctctttctcctcccttctccctctccctttctttccgtggttgaagggcccctcttaaatcgctcttgagcctgcattctaatttgctctctctcccacgtgaaatccacttctcccagctaagctgcgttttgcagctttatgacggtactgaaagcactttatttccacttaaagagctgcctgttctatttaccatcactctcggggtacttaacctcatttaaaaggctaacttttctcctgcattataaagttgctcgggagtctcaaagcctctttctctgcccagcccgcagccagccctctccagccaccccagcctcgccctcacccctcccagcctctgttccaaggcccaggcgcgcccgcgtggggcacgtgtccctgaacgccccgcctccggccagcctgaccgctcagtgctcggtgtcacttctggcacgtctccacattcctcaaatcccagagaggacctcgaaataggatagaaaacaagaatttaaataagaagcaacagggctgcccgctctggctggggagggcctcggcccccgcctgcacctgcggcccttgtttcttgcgcggttttgcaacgtcagagccgtccacactcgcaggccatttttagcggcctgttggaaagggaagacgatgaagtcgggctaagcagggcaacgccttgccctctgagaggcgtggagggcccttgggaagctcagagagctacgataaaatggctaaacgaccttcctctcctccaagtcaccaaatacgaggcaggagaggtgcccgatgagctcccagtcatgtggttcagggcgggctctggaagactcacagaggagactcctccgagaaaccaagaaggtttctgtccaagtcgggatctgctctgctcaggatgctcctccaacacacacagtgaaaaactgagcacctagagagcaacaccaaaaacccatggccaataatggagagccaaatcaggagagcattcagcaaagcaattcttgctgtagaaggaacagcacaaaaagctggaaggaaactgaggcatgcgtgaaagataacttgtcagtgtttgcagtctactgagatccccgctgcaagaaaaggcaggatttccacttgcttcttggcccgcctctgttgtccagaatccaggacaggtgacaagagaagcagatgtgatctgcacaagctggctcagctgggttgggagttgctcttcctggacaggccgggaagggtgctggaggggagggaggaggagagaggttttaggggaggggtgctgagcagtcaggtaggttttctgtgtgtgagaagaaatgcttgaacatggaaatgaaaagttctaactgtaggatggagtttacaggctcaactctaagctttcagaaagcatctcttgaaaataaaatcttggatgttgtagcaagtgctgtgtacatgctcttcagctcctagccccatcctactactgtgaaagtgcatgcctgtaaactgccaccctccagcatctttttctggccattagagcctgattttcctgaagattcagcaggttggaatgccagagaagtaatgccctacctgcacccagcagtgttccaccagtggctatgggagtggctcacacactccagctaccttccttcatgggactggaacctggagttcccaagagggattaggctctagttgtccatggggcagctgttttactgtcaccttccctgtcctgtctctcttcctgtctccactccctacagtgctcccagagataacttcccaaatttgctgcctgcccttggatgttattttagggttggcttctgaaggaacataaacgaagacagacagatgtgctgggtagctatgtgtaagatcacactgaaacatagccaagaacaaggcactcagccactcccaggtttaaaatcaagtttcctactttgtctctctggtctgaatctgagtgaaagcccaggctcctgcgtcacctgggccacctaaggatctccctccagcctctgggtgctgaagctccacctgccctcaccacatcacaggaaaccgcgagcacatcctcctgccttctccagcagtctcttcagtgagcgcctgcagaactgcatctagagcaccgggccaatattgtcaccttccctgtcatggcttccttcctgtctccactccctacagtactcctgagagccgggagcactccctggagcactccctgattcgttttatcttctgcacaactgtttggctggaataggaagcaaatggcatggaatttgcatatgaaaagccattcccacctgtgtccttgtgtctgtaaggataggaggatccaatcttcttatctgaccagccctgtcaacaccttcatcttgtttcacatttgtgaaggtcggggaggcatctggagcttcttgatgtgtcagctcggaatgctgcctgtgggctgggtcggcttcaggcctgcaggtcaagagagaagcacagacaaaggcaccacagagatgcacagtgacactcaaagaggcagcgagacagagatgaaggcgtcgtgctgtgagagccatcgcccggcagcatcccctctcctgggtgtgaattatgtcctccaagggcctcagccactgcagcttgaaagttacttttatgctatttccttaaaaccaacaagaacacttgacatttctaggaggctttgagtagagaacactggtggttctcgttggttgtgtaactctgccaggaatttagaatattgttagaatctttattacatttcagcctgataaggagatgaaatagctaatgaatccactaaaaaaactgccaagtagcaaagctggaaactttggcctttggttgtcgtataataacacaccccaggcacagaaggtttagcacatttttccttactaaaacacaaaacaacaacaccaataacccaatgaggagtcttcaactcctcccaccccatagccctgggc

SEQ ID NO: 674 - DNA, 1623 bp, Homo sapiens
ccctgtgaagaggtgccttccaccatgattctaggtgtcctgtggcttccccagtcacttggaactacaatagctgaagaatgtgagaaagaaaaatcaaaagcacacaaatgagactgtgcagtgaagaggccacagagacaaccatactgtctttttgtatcacaataagcaaaaataccaaggaaagaggtttattgagcacgtggttctctaggctgggaagttcaagactggacagctgcatctggaagcttctggtaaaggctttgtacagtatgaaaatatagagaaacagaaggggaagcaggtgttgttaagagaccagacatgagagacagcctcattttataacagccagggtaactaaatcagtctgaggagagcaagaatttactcttggaaaaaagacattaacttctcttaacgatctaatcttaaggcacaatgtctcaacaatgtctcacttgggaacaagcatcaacgtgagttttgatgggaacaaaccatcttcaaattatagcagtttacttttcactctattaattgtgttctttgatgaatgaaagtttttgattttgatcaaggccaatttatctatttcttcttttttgttatctgtactttttatgtcatacctgtaaaatcattgccaaactcaatgccatgaattcttttatccatattttctcctaagagttttatattttagctcttatgtttaagtctttgatacattttgagttaaattttgtacatggtgtaatataaatatccaacttttgcatgtagatatattttcccaagcaaaattgttgaaaagactgttcttttcccatcgaataattttggcacacctgtaaaaaataactggattatgaattcaggggttgatttctggactgcctattactgccaattagtatttatgcctgtaccacactgttttgattactgtagctttgtaataacttctgaaattaaggagcataagacctacaagtgtgttttttctcaagattgttttggctattcaggtcccttgagattccatgtaaactttaggatgtatttttctatttctgcaaaaaacatcattgaaatttttatagggattttcactaaatctatggatcattttatgtagtattgacattttaacattattctaatcagtgaaaatggatttccatttatttatgtcttctttaatttctgtcagcttcattttatagtttttagtgtacatgtctttagcctgcttggttacatttatttctaagtaaatgaaattgttttttatatttccttttcagattgttcattattagtgaacaatgatatgcagctaaatttcatgtgttgattttgtattctgcaacattgctgaatttaaattagaactgagccctattagttttttgccacatttttaggattttctgtgtgtaagatcatgtcttttaaaagaaataattttagttttatttttccaatttcaatgtatttcatttatttatttgttgcctaatttccctggtgaggagtctattaaatagagggatgaaagtgggtatccttacattgtttgattctaagtttctttttaaattataaacacag

SEQ ID NO: 675 - DNA, 3965 bp, Homo sapiens
cttcctgccatgtggtgacagattaaaagctgctatacactttggaactggaaactgagctcccaatataaaggagataagccatcatgcttacaatatgttgtgcagagctcactggtgggcagtttttcttaacaatgcatcaggacttttgctatttgtaaaggaagcttaaaggaagctgagagtgctgagggcacatctgaaaccactggaggttggcgacgtggaggtcaggtagtagtgctctcccaccaggagtccctctgcacccctggagagagcagtcattatgcaggacaacccatctgctcagaactttcagtggcgacttgtggtgtgactctgttcccattcatctatgtgctgctgtaggcttagcttcccacagcctccccagctttgccatttgtcattatcatttactcttaatatttattctatctatgaccctgatgcacagagtgatagctgatagtctcttaaaacaacgtttacaattattttgacagtttaccgtgttttgttctctcaacaatacttagaatttgtctgagttatagttgcatagacggcaattttcctgacctagttttctgactatgatttatgggtcagtaaactccttaaatgatggaatataacatctcaggccacagggaacacttactatcacatgctcactgttgcaggacggatgcgtggccagcctcaggttgctaaatgttagggtgatctgccttccttctggggcggtgattctccacttgtagatccggccatgaggatttaggttcgggtagttgggagaagtagatgttccagcagagccctgaagatccccaccacactctgatgtgggggaagaaagccaagaaaacttccaatcaaatcaaaatgtctccttccatcaggaaagctctcaaaattcaggtgtcctgcgtgtacaaagaaaataataaaaaacaagaccttgcccatgaagaaatattaatctctctcaagaaaacaggaaaacatgaatgaaaattaacatattcaaatatatgaagaagtgaaaaaaatgcaaccagttaggggaaggatatctcaggataatgaggaaggccagttttttggttgaaaaagtggtttgagacaacagagtgacaaatatctgccttatgctactgccaggagacatgcatgaccctctttctgcctcaagctatagaacacccctcaaataacggcatctggcaatgggatgtctcagcagcaacaggttgccttcccactaccgttgctctccccaggtggcctccagggtaggctatatgacacctgggctctggacatccattgttaatggtagaattgaggtagagaatcactggtactgcccaaagcccattaatctgcacttctttgcagagtatagacatgctttgcctttcttggaagtgaagaaacttcagaggctgaataagtacatgcgaaaataaacaccccaaagagagcagatatatttcactaaccagaagtatgatagtcccaggtctccacaaagtctttttcacagccagaggaattctgaaggttaaaatcttcaaaagagatggtgagatagtgtctggagagcccctggagatgccaatcacagaataagttgtctctatatggaagcattagatggccaatgctttcaacaacaccactttgccctgttactcttcccccacactgagctgaaaaaaaaaagaaagaaagaaagaaaagaaagaaaggattctattacaaactgtgtttttttcatttcaccagcacatgtgaaaacttttaggtgccaagtgactatgaattgaagtttttaaaattctgaaaatgcttagtgctttcctcattatttgaattctagggttgatgtaaacagaagtgataccacaagtccaatccaataatgggaaacaagatgacgaccaaatggcacattctgtaatgtcacattaattcttttgggacactatgtaagagctatcagttgcaagcaagtttcatctcaagaacaaactggtagactcatctgacctgcctagaaccttgtgttgattctaaagactgaacccaagctcacctggaaggggggacacctgctatatctagttttactatcaactaaactttcactactgtaactgatatctcagggccttgaaaattactattcaattatgtcttattagctggatgtggtagctaattgaattatatgcagcttgacccgggatataatatgatctatggtgtagttaaatactgttacaactagcctttctgaacttttgctatattaaatatttgtttggtttgtgtctagacctatcagatactaaattgtgtgctattgtgaccatactatagtgaatcttcaacaagcaaagttactgctcaatttttaagtaaggaaatcaaaatcctgaagagacatatttgctttttatccagtgactgatttggcactagagactcagagaaaaaaaaaaagcttaatcattttatatatgatgaggaattcaaagacattgttctaaatatagttatctggttcttaaatagttgtattacttaaagtaataaacatactgtagttcttccttttccttggcggatacattccaagtccccccagtgagtgcctaaaaccttggatagtaccaaaccctatatagacatatagacaatttttttctacatatatgtacctatgataaagcttgctttatcaattaaacgtagtaagagattaactaataataaaatagaacaatcataacaatatactgtaagaaaagttatgtaaatgtggtctctcaaaatatcttggtgtactgtactcacctattttttgggcctctgtttaccaagtgcattgaaaccatggaacatgaaaccatggataagagagaactactgaatttcatagtaagcagaagaaacaggagtttgatttaactacacatatttcttcacaaataagttagaaaaaatataaaatattcaagtttactaagattacattttaaaataaaaattaaaagagaaattaaagttgatgactgtggttttaaacatttacactccttacttatttatagcattaaaatatttttaaaattatgcagatagaatgacttctttttaaaaagtcatggttttaaaaaaagttttaacatattcatcctgtaataactcttttatttaatataaaaatgttttccagggtttttatagttttgtgttttacagttaagtcttcaatctatcttgaattgatttttgtatatggtataaggaaggggtccagtttcaatcttccgcatattgctagccagttctcccagcatcatttattggatagggagtcttttccccattgcttgcttttgtcagctttgttgaagatcagatgcctgtaagtgtgaggccctatttctaagctctctattccattttattggtctatgtgtctatttttgtaccagtaccatgctgttttggttactgtacccctgtagtatagtttcaagtcaggtattgtgatgcctccagctttgttcttttagtttaggattgccttggttatttgggttctttctggggtccatatgagttttaaaatagttttttctagtactgtgaagaatgtcatggtagtttgataggaatagcattgaatatgtaaatttggggaagcagtatgaccactttaataatactgattcttcctatctatgagcatggaattttttttcatttgatagggtggagggtgggagaagggagaggggcagaaaaaatagctattagatactaggcttagtacctgagtgatgaaataatctttataatgacccccatggcacgagtttacctatataacaaacctgcacatgtaaccctgaacctaaaataaaagttaaaaaata

SEQ ID NO: 676 - DNA, 7985 bp, Homo sapiens
gcacacacgcacgcacacacactcgcacacacgcagaggcacgggagggaaagaagccgatgaataattttgctattttttaaaatactggccgccatcatcaagcagcgagcagcagcagaagcgttgaagggagaggaggcatcgggacaggcccctcttaggagaggatttatatctagttggaaaaaaaaagaaagaaaagaaaaagaagaaaaagaagaaaaaaattgtcaagcccccgaactgaaggttacgagcggcccgtcagcagcccacatgtaaccgaactgtcgtgtttcatggctttttgccactccagctgtcaatcaaagcccggaatgtcaaggtagtgaatgaatgatggttgatgatgatgaagaggaggaatctttcagacccgtttttttcttccagtaaaactccgcgaggggtttctgcttcttgaattttttcctcccccctccccccttttttagctttgcccccgcggtatctataatacgatcctctctctttaaagtattgttcaaagaaagcagtgagaaaaatcaagaaaaaaaaatgaatagtttgcaaaaattggacttcctccccccctttcctggaccagaagagaccagcttaactcagagcacactccctccaagcggtgcggacaaggggccaccccgagagtctttgggggccgcggcggaatcgggagggaggaaaactccaagattaaaagtatccttatttgttgctgagttgctcgtcgacatttaagagaaggtgagtaaaaaagaaaagaagatgaaagagaaaagaaaaagttggtctccagaattttatttcaatcgacagttacgcgaattcagtttagccgggaccgggaggtttgagagtgcggcggggtggggaggggaaaaaaacaaaaacgctgcggagcgttttcgactttgcaaagctgttgatgttggtgggtccaagttcccggtgcagcgccgctggctgagaaatttgtactcagtttttactcttctaattattcttaaattcaatttaagaatttaagtttatcgtcgccaataggattattgttgttttaaatgtcttgttcaataagtgccagttacgtttctttttaaaagaaattcctcagtgtccttgataaacctttttttgtaaagatcaacttcatgcggaacctctgccttgcagggtttaaacattcaacattgctaccttctgtttctttttctgtttttatagtgatactgtaaagtgagttagcatctctatagctttcatttagaaaaacttaagtcgcatttttagaaaaatattccttcccttgcagtgtgagtaaaaacaactcagacagattgatgatttctatattttcttttctttctttatcttctttttctttttttcttttcttttctttttttttctttttttttgagacggagtctcgctttgtcgcccaggctggagtgcaatggcgcgatctcggctcactgcaacctccgcctcccgggttcaagcgattctcctgcctcagcctcttgagtagctgggattacaggggcgcgccaccacgcccggctaattttttgtgtctttaatagagacgggggtttcaccatattggccaggctggtctcgaactcctgacctcctgatccacccgccgcggcctctcaaagtgctcgaattacaggcgtgagccatcgcacccggccgatttctatgttttcaaacaattgtaagctaataatgagttgattatctggtgataatcttgggttttacaaaaaaagaaaagtttaaactttattttcatgtgtttttatcagatgcagaaggcatttttaaccttaacgcctttctctgtctctctctttcatattcttaacttcttttgcattttattgaatacattaaagcaaacaacaggaacaatatggttaggtgtaggagggagagagaaatatgacattttaagatattgtcaaaaagtcatatttaacttcaacgacttttagttaaaaaagtgtgagagtgttgaaagtgcattcctactggaggaaatctatgtctttttaaaatttgccagttgtctcaggggagaacccagaatttctttgaacgaaagagatcttactgatctagttgcatgtcacttatgaaactgttagtttaaaatagcagtcctagtgtagtggattacacatgaggagatcaagttggagtcgattcaaggtattggttcttggtcagtctgctgaattcaaaacactattacctttaatcagcaacttgcgggtgttttattaatagagctgaaaaaggctcatctaacatataagaatttcctggtttccctcatccccaattttccagtccaatagaagcgattccaaaggagtagggtacccgcacttactgatttccatcctggtggcattttgctaatgccccattgtcagcgttggcactcccacccaggcttccaggctcatctgctctcccatatttggggtgaaaggaaagtaggtggggcaggcccgggagacaggcacgaaatgggggtcgcaggaggtggcacacacctccgtcaacagtcagctccttctgcccaggctggaaatggttttaacaggcggtaaaatttcatcttgcggtgtcaaattggggtcattttggggttagagttctcagtgtccgagaggagctgtccagctgcgtggggactcattaactgcaaaagatctgtttcagtaaaaacaattcaaagacaatcagaaggctaaagaccctctacaaatcgcattttacaagtgccccagaacaaatatggatggtgaaacctatttcttcagaatcccaaatcagctacttagctctggagtgggggtgggggtactgcataaaaaagaggtgaaaaggaggggaccaagcgggtggggaccagtggaagggggaatcgggcctctcaaatttaagagtctgtttttaatcacctctttcttattgaagcagccccaagagttctgaaaactgctacttttctatttttcattttctttttttgagccaacatggaatgctattataggtaacatttaagatttaaaaggaataattgaattccactatagtcccttaatttgaagggcattggctttatggggagtgtttaatttgaaccaagaatttatgaacccagactctaggtgaatttgcccacactccttaaggagcttgtgtagctgtttctttttcttttccttgaaagttatagcttcttagcacagataacttcaaattcctcagaactgagaagtccaaagtgttaatctgtgtattaaaatcgccaggtttaaatcctttttgtcttcttacaacagttagaacaattgacgccttgctagagaagcaaataagtccaaccttaatcttatctgtaactttatttaatgttttgatttggaatattttggattaagcatatctttaaaaactctgtaaggttaatttttattccgggagggaagttctctttactgattttgaaaaaagacatgaattattactttgattttcaaaaattccttcaggtaaaaggaaaattcaggtttaaaatgagaagctagatatgtgaaatgccagagattttaggataaaaccaagtcaatacttaaaagtaaagtatcatttgaaagaaattttatttcttgcattactgaactgagcaagtaacagtgatcaaaaatatgttattctctctccatctctctctctctctggactccacttctgtcactaggtcttctctttccatccccagcacttttctttgggttctgaatgacacagtgattttttttttttgtagtctagttattttctccaagcgtctcagagtatttctaaattgttattcaaggagtttgatttcagccctgcagaaacagccctgagcccagcatcgctgggacaaaggcagaaggggctatcttctgttcaagacctgctggctgacagttggaatttttgatatatattttatttggcgtttccaataacgtgtttgtctttccctctccaccccttgcagccatctattacttttaaaacatcccttctccataaacatcggctcatccttgtgaactattcttgaccttcccagcagtgtaaccagcagctctgaaagttggcctagaaataattccactggcttccttacctgttaactttactcactcttcctagctgggatcaacagaaggaaggggacttttttgtttgcttttgttgttgttggtggtggtggtggtggtggtggtggtttttggttctttggtccttttcccacttaaactttctataatgatttattctccgcctcctcccattaataacgtttaagcaccccacactttattttttaaataaaatggagtaaaattattatacttttttcctttatgcccccttttcttttatttctcccaattttaggggcttcaccatctcatagaaaggacttcaataaatagccctctagcgctatctggcggggctccaaacacgacgtgcgcttgctctcactgtttcttcctccttcccgcgctctcttctttcctctctttcttcctctctcctgctttttctctcgtctcttccgctcgattgttttcctctttttttctgtcctcctgcggcctcttgtctagttcctacccctacttcagcgcaggcggcttggaaagccccggccagaggctagtaactctcgcaagtgggagatgctctggcgacggatctctcttttctgatccctcctcccccttacccagcgcggatcacacacatcctttgcctttgattagcatcttaaagttgcttagcgtgccgcttaagtcccagcgtctcagctggcggtggtttggagaggcttaaaactgcattcatgaagtttggaggaaagaaatcagacactggaattcagggctaggagcccagctcagttttaggtcagaaggccgagtctcagtgcgagattgaggaagggtcggggcttaacgggggaggtgggggtggcgggggggggaacagcacggcgcggcgcctagcctgcgagatggagtcggagtgggggtgcgagcggtcctccaccgcctctgcccgatccgtacctcacaatggactgctcgagtttgtatctaggcctgtccaggattgtttactccttcaattaatcagctttatctcttttccccctccccccacctccaccaaatctggagaggagtgggaaagaactggaaaactcacagggcaaagagagaaagccaacagtcatagtgcgggaggaggcacgcctgggatgcaatacccaacagtctcctccctgctttcctgcaatttgcaggtcattgtctttcttatttgtagctttttttttttttcttcagtagccggtaaacaatcgaacgccgggtagggaggtcagaggggatggggctgtgggagagattctactcaggctaggtgctttagatttggacctggctgtgtccctactttattaaaattctcatgtggcgcgcgctgtcttctctcttctctctctctctctctcacacacacacgcacatacacacacagcccgagagaaatttccaatctttgagcaaatctcttccatctagtccttgaaacagaggaaaggacatgggacctgaaggagagttatgattgaattttctaaaatttagttttgacattgcaaagtaaaagtgaggaccgtattcccaatacagacccagagggtggttatttcaggtgaggggacctcagcctgtgacgtctatgatcaaccagacaaagaccccttcctaaatctgaagtcccacccccacccgtggcaaacatggaatacaagggaggggaaggatggcacaatagtgggttctgttttccaagaactgccccccacctccattgcagaaggaaaaaaaagcacggttcgggtgtaattaattggggactgttattaggtcatcattagccaaggtacaaataatagcagcacatttttacttaaaattgaccagccccagagtgatagatcgatttggagtataaaaagatgtatcaaaacatcaatgtcgattatttgaaatattgtagtcgaattttttttattgcttcatcggttaagtgtctgaaaatgcagtgttcaaacatatatttatgttgtcaatactgtcagaactgtcagttttactatactggatttgtactatatttcaaatatgctaatttacataaaatgcccaccctaggattccccccctacacccaccccatctctggaaaatccgtgtcagtttcttcaaaggattcagcaatctttgcctaagctaaagtgtgcactacctcttttactcaattttccacatcggattacatgtctttttcaccatctctaactttcaaagagatccttcttcctttctccccaattctgcctactctaacctcttcttcaaaatagtactgaggcacttggaaagcttcgaatttaaatatccacatcccagctccaaatataccattggagtaaaaaaacggaaaaactggacttgagtgtacttggccgcactcgggtaaaccaggcttcaccaggtagacgttctcataccgtaagggtccatcatcaaattacctggcagattgaaatcttccagggaaaatgaatttggaaatgtaaacaccttttctttctttttacttaaaagcctcgatggtagaaaaagaaataatacttataaatgatcggcacgttttaactttaaaagcttttgaactcaagtgaaagacacacgttggaaacagaattgatagttttaattctacccattttcacctggcacatcagatcagtggcaatcatttattttatggggtgtggaggggaaagggatagaaagcggatagaaagctagaatccactgaagtccctgtcctaaaaatctcagagaaattaaagacttattgaaacacaaacattccatcgctccatactctccgtccagatgaattgaaacttataaatccacgctctccccaattttatgttttttatttattttttttcagggtttgataggaaagatacccaagtctgatagggaagacagggccacttctggactagctgtgaggatgtgttttcatttccataacactgaagcactttctgtaaaccttttgatgtacttaaataagtctatttggacatttaaagaagctacacatacaaacatagcttggctttttgccgtcaatcccagcattaaaaaaacattcataatctaactgagaagctctttcatacccatccttctttcaaataagtaaataaataaagaaatagaagtgcaaaccaaagaaagtttccagcgtgcatctgtacgtcttcgtgtgcgagtttataaacaacttccagtcggtacttgggtgttacctccctcctgccacacaccccaaggcagaggcatcgagggatcgcccccagagagctgtgtttacttagcttgttttaaaaaaaatctcgccgccatgtatgacaagtgttactgcaagaaattcatcagccttctacagatacttccagttttgctgtaatgatctgcagaagagaactgccatcactttctcacatcccaaggtgttgcaggaactcagagagaggggagagtggctgaaacgcttaattaccggaggcgaaggaggggcgcgcgggggaccgaaggagaggggagtgaagaaggaaggtcctttaccaggcttgtacctggagaaagctttgaatcgcttctctgctatatttggaaaaggtatgcttgctttttaaaaaaatgcctttagggcaaagtgatacccttgtgtaataattaactcagacaataaaaataattgga

SEQ ID NO: 677 - DNA, 1903 bp, Homo sapiens
attgaacatttaatattttggatgtaacttttgaagaaagtatgctttggtgcttaaaattgtatatgattttaggtaagaaactttgataatattggcataatttagatttattttctttcttttttttgagacagtctcactcagtcgcccaggctgaagtgcagtgacacagtctcagctcactgcaacgtctgcctcccagattgaagtgactctcgtgcctctgccacagagtagctgggattacaggcatgcaccaccacacaccgctaattttttgtatttttagtagagacagagtttcaccatgttggccaggctgcgaactcctgagctcaagtgatcctcccacctcagcttcccaaagtgctagcattacaggcatgagccaccacacctcaccagatttttaaaaaatatataactgcatctctcttgattctggggcttggtaaaaatggatagataagatagtattctaaattcaaattcgtggctaggcacagtggcccacacctgtaatcccagcactttgggattccaagacagaagactcacttgagtacagtatgagaccagcctgggcaacatagatcttgcctctacaaaaaaaaaaaaaaatagccaggtgtggcacatgcctgtagtctcagctgcttggaaggctgaaatgagaggatctcttgagcccaggaggtctaggccagagtgagctgtgatcgtgccattgcactccagactgagtgacagagtgagactgtgtctaaaaaaaaagtttgaattaaaaaaaaaaaaaaaaaagtcggctgtgcacggtggctcatgcctgtgatcccagcactttcggaggccaaagtgggtggattacctgaggtcaggagtttgagaccagcctgaccaacatggtaaaactccatctctactaaaaatacaaaaattagcctggaatagtggcgcatgcctgtaatcccagctacttgtgaggctgaggcaggagaatcccttgaacccagaaggcagaggttgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaag

SEQ ID NO: 678 - DNA, 2018 bp, Homo sapiens
ctgtgccaacttgtttcaccatgttaaactgcatacatacccatgaactatttatttacaatacatttgatctcgttaagaccccagttctatttccaaggcatgcagcccaaaaccaaaaagttaaaagatgataacactctgtggttgaattacctatggaaaagaatgaaggcagttcactctgtttaagatgtggagaatttcctacaaatagttaaggtgaaataaaatcattaatagagagtaggttccttccatttgagtaagtgatctagaatatgggataccacggttctttttagagcattttcagtgtagcctcattaacttctccaatttaatacgacatacatacttcttccacctgaacataaaattcaagaataggagcatcctacatctttcattctttccaaacattacctctttagtaaattcgggttgctataacaaaataccatggactgggtgactaaacaacagtcacttgtgtctcaagttctggaggctaggaagtctaagattagggtggggcagaataaattattggtgaggatctgcttcctgatttgcatgttggagaaagggctctggcctcttcctcttctaataactacaataatttcatcatgggggccccaccctcataatctcatctaaacctaattacttcccaagcgccccaacttcaagcaccatcacactgggggttagggcttcaacatatgaatttggggggggatataaaaatttagtttatagcactcattttcaggtcaaagagcccacttccctaatcacatacttcaataactagttaggtaattattgttttactcttttgtagattagatcagagacattaggtaacttgtccaggacacacaacatgcatttttaattaaattggatttaataacccttgaactttccatttatatcatgcttatctccagaataggatctctcctaaggaggcagagtgatttaaacaaacatgtgctgcttcaatctcctttactcctaaacttccattgatattgctagggacaaaaaattaagcaatgatctattttaggaaatcaaaatactgttcattgaaaagcagttttaaaacaattattgacatttaataaatacagaattttcagagggcatctcttctatttcaaggttacctcccagaaaaactgacattctaattttcttctcttgaaagcaattagaaaaaatgctaagaaatgattttatattttttaaagtagagggccaatgaagtgtctaacaaaaggaaagcatacagtaaatgaaaaataaactagttatcagattgtcttatatctttccttcataggacattgatacagacatcatcaaattcctgtttgtattgccttatacatacttaaaaaacaagatatttacaaaaatattttagatattcctgtctaggaactaaaattacagctgatttagaatttgcttaattattcagaaggaattgaagtgaaatgaggaatacaaatttacttgtcctaaatttttaaataaaatgtattatattttgtagtcaattatatataccaaaataatgtctgaataagacgtaatcctgtcatgagttctctcttccaaaaaagaatgcaagagaattgattatcttagttagaccccatttttaaggaaaaaatacaccctgtatgatacattcttagatatatgggtttgagattattaacattgataatagtttttttaattcatcatctctaaaactctaaaactttagtgagaaagataataaatagaaaattaccctggaaattaaaatttttagcaatattgaatacagtagtataattttttgtggctcttgatttcctaagaaaaatagtgatttttatttaatgaaaatttctcaatttggttaatattctaagaaaagattgatatatttaagcatggtgattagaaaaatatgcatatttcctgctcataataaattttaaaacaac

SEQ ID NO: 679 - DNA, 9590 bp, Homo sapiens
agagggcagcaaccgacttgtgcgaaaggagggaacgtgtgggtctgccagggtcctgcaggggggatgagaccctcgctccgctccggcgatcccttcgctctccaccctcggccagcccctcctgtcctccatcaggcctcgctgaggatacctcctgggttccaaagcgcgagttgaacctgagcttgacattcattccgtctcgtacaaaagccatgcctgcggggagagggagaaaatttcctacaggagcctcaagactgcgtttcaggaagccctaggacccactgatcctgcagctgcgcctctcactcgcctcaggtttggattaattgtcactttctgttaagctgacatttatggagggcctagtgcgtcctgggtgctgcgctatttaggctgttgcacagaggagtggccaactccagcaaggctcttgctttgctgcttccccattcttcctccgcctgtaatccagacaaaagcccacattgtaaccaatccaggggcagcttagcagtgccaagcaggcagctcagaggccactggtaggacagggcatgatcaacaggcctcctgatattttctaacatacgtattaacaagaaagaggaaattaaaaaacgaagatggacaacagaacttcactctgacttgagtgacttttatcctcatttggataatagttttcaaaaattatttgtgagtgtatatgtgctattcacaaagcaatggctactgacccaacacgtatttacatctcttcttcattattgcatttcactccgtaaatgtcttagcctagacaatcaacaaagccataaaccaaatcctgatttgtagcatttgctgacttctgtgtttaaattacccatcataggcgattttaagttacaatatgtagtcgttgaatacagatttggagagagtcacaattgcacactcttttatatttttccacctaaaaggtacaatagacataaataactctaagaacacagataacagcaaaatgtagcaactaattaggaagaaatgaattttgtgtctccattacttttccagtaaaattcatctaacaagtgtattacaaacaagtgtatgcaattgaattttaactcaaaattttagaatttgaacaattgatgctagttagggtgtgagctagctccagcacataatcctgtcccgtgaagagaagttttatggcttacatttttagatatatctaagtttactggaactcaaatacagaacaaaatcccaccaaaattaacatatactgtcatatataaatatatacacttttatatgtgtacatatatatgtgtatacacactttaatatatgtatatatgtatatatactttatgtatatgttttacatatatttttaatatatgcatgtatctgtatatatacttttaattaacagtcatgttacagagggcctactctgacagaaatgtacatctctcagaatcattatcatccagtgcaagtgtcagctaactactgccaataggctagatatctctagcttgccacctggttttgtactgccagagagctatgtatggattttacacatttatactgtaaagaccattatcttttccacatgaacagttgcttgaagagttgagggtattggcagtagcaacaacagacaactaaagaacaaagcaaatatccagtatgtttagatgagttggcagcaatgctgttatttccttgaggagttaatgttgagtttgaagtcactaaagaatcatctcctatgaatagtctgctgggaacaactatacatgagaatatttttaaagaagttgagaaaatatgaattcattacaacctgaagtacaatctgctaagatctctttcaattgaatctgagacagtatgtggaacagaaaaagtctaatttgaaaaaatttacaaagcttgtgaaaatatacgttgtttatttatttattcattttattattcatcagcagtactttgcataaaacattttaatctatcatttgttatttaaaccagcattgtcattgctgaactacattcactctggtgaacagttcagacaactagaaatgaaagatgaataccctgagcttgtcctactgcatggcagtttgatgggttaggactcaatttttttgaaatttttgagcttaaggaagagatcaaaatatttttctgtatgaaaagaatttcccttggcctgtactaacaaccactgaatgactttggaaattagcttttgctacagacttgataatgcttcttatatctttctttcttttttttttttttttttgagatggaatctcgctctgtcacccaggctggagtacagtgactcgatctcagctcactgcaacctccacctcctggattcaagtgattctcctgcctcagcctcctgagtagctgcgattacaggcacgtgccaccacgcccagctaatttttgtatttttagtagagatggtgtttcaccgtgttggtcaggctggtctcaaactcctgacctcgtgatccgcccgcctcggcctcccaaagtgctgggattataggcatgagccaccatgcccggccttgataatgtttcttaatgaattcaacctgtatatatacaaggcaagatggtgcttatatatggaagttatactgcaatatatcctttagataacgaatgttatataaatccctagtaatgttgagttgatctgtaaatttcttatgttggaaaaagtgaaaacaaaatgaactccattcccacactatttgaagcatctataatttcccagatcaagctacagcttcaattacatttttctcatctttaggaaaggacagaggaaattctgatatctcagaatctgtttaattttccaattgagaagctgccacctaacttttcttttctttttttttattttatttttcacagagtatcttttttttattattatactttaagttttagggtacatgtgtacaacgtgcaggtttgttacatatgtatacatgtgccatgttggtgtgctgcacccattaactcgtcatttaacgttaggtatatctcctaatgatatccctccccgctccccccaccccacaacaggccctggtgtgtgatgttccccttcctgtgtccatgtgttctcattgttcaattcccacctatgagtgagaacatgtggtgtttggttttttgtccttgcaatagtttgttgagaataatggttcccagcttcatccacatccctacaaacgacatgatctcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttacaatcctttgggtatatacccagtaatgggatgcctggggcaaatggtatttctagttctggatccctgaggaatcgccacaccgacttccacaatggttgaactagttgacagtcccaccaacagtgtaaaagtgttcctatttctccacatcctctccagcacctgttctttcctgacttttaaatgatcaccattctaactgctgtgagatggtatctcactgtggttttgatttgcatttctctgatggccagtgatgatgagcattttttcatgtgtcttttagctgcataaatgtcttctcctgagaaatgtctgttcatatcctttgcccacttgttggtggggttgtttttttcttgtaaatttgtttgagttcattgtagattctggatattagccctttgtcagatgagtagactgcaaaaattttctcccattctgtaggttgcctgttcactctgatggtagtttcttttgctgtgtagaagtctttagtttaattagatcccatttgtcaattttggcttttgctgccattgcttttggtgttttagacatgaagtccttgcccatgcctatgtcctgaatggtattgcctaggttttcttctaggatttttatggttttaggtctaacatttaagtctttaatccatcttgaattcatttttgtataaggtgtaaggaagagatccagtttcagctttctacatatggctagccagttttcccagcaccatttattaaatagggaatcctttccccatttcttgtttttgtcaggtttgtcaaagatcagatagttgtagatatctggcattacttctgagggctctgttctgttccattggtctatatctctgttttggtaccagtaccatgctgttttggttactctagccttgtagtatagtttgaagtcaggtagcgtgatacctccagctttgttcttttggcttaggattgacttggcaatgtcggctctctcttggttccatataaactttaaagtattttttttcaattctgtgaagaaagtcattggtagctcgatggggatggcattgaatctataaattatcttgggcagtatggccattttcatgatattgattcttcttacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagatcactcatgatttggctctctgtttgtctgttattggtgtataagaatgcttgtgatttttgcacattgactttgtatgcttagactttgctgaagttgcttatcagcttaaggaaattttgggctgagacgatggggttttctagatatacaatcatgtcatctgcaaacagggacaatttgacttcctcttttcctaattgaaaaccctttatttccttctcctgcctaattgccctggccagaacttccaacactatgttgaacaggcgtggtgagagagggcatccctgtcttgtgctagttttcaaagggaatgcttccagtttttgcccattcagaatgatattggctgtgggtttgtcatagatagctcttattattttgagatacatcccatcaatacctaatttattgagagtttttagcatgaagggctgttgaattttgtcaaaggccttttcggcatctattgagataatcatttggtttttatcgttggttctgtttatatgctggattacatttatgatttgcatatgttgaaccagccttgcatcccagggatgaagcccacttgatcatggtggataagctttttgatggtgctgctgcattcggtttgccagtattttactgagatttttgcatcgatgttcatcagcgatattggtctaaaattctctttttttgttgtgtctctgccaggctttggtatcaggatgatgctggcctcataaaatgagatagagaggattccctgtttttctgttgattggaatagtttcagaaggaaaggtatcagctgttccttgtatctctggtataattcggctgtgaatccatctggtcctggactctttttggttggtaagctattgattattgccacaatttcagctcctgttattggtctattcagagattcaacttcttcctggtttagtcttgggaagtgtatgtgtcgaggaatttatccatttcttctagattttctagtttatttgcatagaggtgtttatagtattctctgatggtagtttgtatttctgtgggatcggtggtgatatcccctttatcattttttattgcatctatttgattcttctcttttttcttctttattagtcttgctagcagtctatcaattttgttgatcttttcaagaaaaccagctcttggattcattgattttttgaaggttctttgtgtctctatctccttcagttttgctctgatctttgttatttcttgccttctgctagcttttgaatgtgtttgctcttgcttgtctagttcttttaattgtgatgttagggtgtcaattttagatctttcccgctacctcttgtgggcatttagtgctgtaaatttccctctacacactgctttgaatgtgtcccagagattctggtatgttgtgtctttgctctcattggtttcaaagaacatctttatttctgccttcattttgttattacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagtgctttacttccaactatgtggtcaattttggaataggtgtagtgtggtgctgaaaagaatgtgtattctgctgatttcgggtggagagttctgtagatatctattaggtctgcttggtgcagagctgagttcaattcctggatatccttgttaactttctgtctcattgatctgtctaatgttgacagtggggtgttaaaatctcccgttattattgtgtgggagtctaagtctctttgtaggtctctcaggacttgctttatgaatctgggtgctcctgtattgtgtgcatatgtatttaggatagttagctcttcttgttgaattgatccctttaccattatgtaatggccttcttcgtctcttttgattttgttggtttaaagtctgttttatcagagactaagattgcagcccctgcctttttttgttttccatttgcttggtagatcttcctccatccctttattttgagcctatgtgtgtctttgcacgtgagatgggtttcctgaatacagcacaccgatgggtcttgactctttatccaatttgccagtctgtgtcttttaattggagcatttagcccatttacattgaaggtgaatattgttatgtgtgaatttgatcctgtcattatgatgttagctggttattttgctcattagttgatgcagtttcttcctagcctcgatggtctttacaatttggcatgtttttgcagtggctggtactggttgttcttttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttaaaaattcttttctttacgaatgttgaatattggtccccactctcttctgacttgtagagtttctgccgagagatcagctgttagtctgatgggcttccctttgtgggtaacccgacctttctctctggctgcccttaacattttttccttcatttcaactttggtgaatctgacaattatgtgtcttggagttgctgttctcagggagtatctttgtggcgttctctgtatttcctgaatttgaatgttggcctgccttgccagattggggaagttctcctggataatatcctttagagtgttttccaacttgattccattctcttcgtcactttcaggtacaccaattagatgtagatttggtcttttcacgtagtcccatatttcttggaggctttgttcatttctttttattcttttttctttaaacttctcttctcacttcatttcattcatttgatcttccatcactgataccctttcttccagttgatcgaatcagctactgaggcttgtgcattcgccacgtagttctcgtgccttagttttcagctccatcaggtcctttaaggacttctccacattggttattctagttagccattcgtctactttttttcaaggtttttaacttcttttccatgggtttgaacttcctcctttagctcagattagtttgatcatctgaagccttcttctctcaactcgtcaaagtcattctccatccagctttgttccattgctggtgaggagctgtgttcctttggaggaggagaggcactctgatttttaaagtttccagtttttctgctctgttttttccccatctttgtggtttaatctacctttggtctttgatgatggtgacgtgcagatggggttttggtgtgaatgtcctttctgtttgttagtttttcttctaacagtcaggaccctcagctgcaggtctgttggagtttgctggaggtccactccagaccctgtttgcctgggtatcagcagcggaggctgcagaacagtggatattggtgaacagcaattgttgctgcctgatttttcctctggaaattttgtctcagaggagtaccccgccgtgtgaggtgtcagtctgcccctactggggggtgcctcccagttaagctacttgggggtcagggacccccttgaggaggcagtctgtctgttctcagatctccagctgggtgctgggagaaccactactctcttcaaagctgtcagacagggatattcaagtcttcagaggtttctgctgccttttgtttgcctatgccctgctcccagaggtggagtctacagaggcaggcagtcctccttgagctgcagtcagctccacccagttcgagcttctcggccgctttgtttacctactcaagcctcggcaatagcgggcgcccctcccccagccttgctgccaccttgcagtttgatctcagtctgctgtgctagcaatgagcaaggctccgtgggctaggaccctctgagccaggcaccggatataatctcctggtgtgccatttgctaagaccattgcaaaagcacagtattagggtgggagtgacccgatttttcaagtgccgtctgtcacccctttctttgactaggaaagggaattccctgaccccctgcaattcccaggtgaggtgatgcctcaccctgctttggctcacactcggtgcactgcacccactgtcctgcacccactgtctgacactccccagtgagatgaacctggtacctcagtcggaaatgcagaaatcacccatcttctccgtcgctcacgctgggagctgtagactggagctgctcctattcgaccatcttggctccaccctcactgccacctaacttttcaactggaaatgattactctgtaaagcaatgacataataaaatacaaatattaagaaaatagtctgacagaattctatctgccttttaagggataaatttgtacaattgaaattatatgctaatggattgatatcagtatttggcagttctcttaaatgtgaaaagctatttcaaagacaaaatctgtaaaatctcgtttcagatcagcattaacagatgagcaattatttatgatgagcacaactttgaacactgattacataaaatgttaataaaataattatcaaattgtacttgatttctattttgtgtttcatctataatactagcaagaatttttcttgttatacgaggatctgcattttatccttaattttgccttcagcctggaaacctaaaatatgtagtatctggccccttaaaacaattttgctgattcctgatctacttgaaaataaaattag

SEQ ID NO: 680 - DNA, 2954 bp, Homo sapiens
tcttggctcactgtggatcctcttcctcctgggctcaagccaacgtcccacttcagcctcccatcatgcccggctaatttttgtaaatttttttgtagaggcagggtttccctacgttgcccaggctagtctggaactcctgagcccaagtgatccgcccgtctcggcctcccaaagtgctgggattacaggcgtgagccaccgtgcccggcctcatttatgaaactcttatctggcaggcaatgtgcaatgtgcttggcataaatatctcatatcctcacaataatcgtgtaaggaagaaactcggactcaacctcaagataagcaccaaagctcattttaaacctcactgccctctgcaagataactatacagatgctcctcgatttatgatgggttgcttcccgataagcccatcgcaaagttgaaaaatcccctaagtcgagccaccctaagttggggacgcctgcatcatgctttcagaggtgaatgtaaagtgggtgaagcggctcagtgattgagcgctagccaggattccacgccaggcctttccgtgttcaacagctgctttcagaagtgtggaagcctcggagagggtccctgaggtaagatgggctgagcgtcgccgccttctgcaaggacaccagccttgagagaagagaggagataaggtgcaaacgaagaaaggcagggacgccgcggtttcagtcgaagcgtgggctccttaaggacaggggctgtgtccgactcggctctgaatccccagcgcctacacaagctctgacacagcgtatactcagtaaacatggagtgaatcagttcattcaatgaatgaacgaatgaatgaaacgccagagcccgccacaggggtccgctgccgctccacgcccgggcctctcaccggccaatcaacactgtgactcgtacgccctgccccctgatgccacgcccatcactcgcccctctggattccctccggctgcgtggaaatcccggagcactggatttcccagaggcgcctccggtagcagtgcgcatgctccagcgccggtagctgaggcatcaatttcccgcagcgcctaggggacggattggaaagcgattggcttaggggacggaagccaagctccacctgcctgacacccggctcttcacgcagaaccgaagattcattttggacagcccttccccagtaccactcccaccccgacgttggtcccaatcggaacctatcctacacaaggctgaaaaaaagaggggagcgaccggaagtgacgcacgagcgcgagcggaaaaacaggggcccagcgcctgttgccgtggaaaccgagccctcggcttgcgtcccgggtgcgtcacagctccggctgaccacgccccgcgcgcggccccgaggccctgaggcccagggcggggaccaaaagccgcgcgcttgtgacgatgtcgctgcggggcacgctaaggggcggagaggaaatttagggcctgccttttgtacattcggttattcagcccagaaatatgtattcaaccccaggcgcgtgcctggcattgtggaaggcgacacgtgaggagaattgtgactggcccagatgtcacccccccccagcccagtagtcattcttctctggaagtccttacccatctcacctgttcattcttcaacccccagtttcccgacctttttcctcaagccacgcccttccacgctttcttgtcttttctgtggtgttccttcagtctagaatattctccacctagtacaatcctgctcctcccctgacattctgctgaaattgcactcttcagccttcccagctaccaggatgagacaactctactcagacccaagcacaccaagccaggaatgcacaaaggacggctgatgtttgagataagaactgtctcaaggactttctataataaccacacaaggaattcctcatgtacgtcacaagtctcatgcgtttctccacctacgttttgcacatgtgcacacatttattgatttagaggcagggatcttgctgtgctgcccagaccggactcaaattcctgggctcaatcggtcctcctgcctcagcctctagagtagctgggactccaggcatgcgccaccctgttatttctgtgaccaggcttagcactaggcattctttcggacgacagcaattcaaataagatgctctccaaagaacacttgcctagtagcggcatctccaaaaataaattgatgccgctccggctttgagcctccagaaccaaagaaacctgtttccagacagcttatgtgaacttctacttttggccaataagagctcccacttacccctgccctattcaggtgcacctgtggcttgccatagccatatagccaggtgcaccatcctttttgcctgctcctgaataaattaattatattaggagacatctttctctgatgtcttttttaggttagcaactctaatatgttggaagaatacaggccagctactttgtagaatgttcctcaatttgagtttgtatgatgctttctcatgattagattcaggttatgtatgttttgcaaaaatacctcagaagtgatggcatccttggtgcggcatccttggtgcattatatcaggaggcaaatgatgtgggtttgtcccattgtttgtaatggtaacattggttgcttggttaaggtgaagggtgccaagcttctccactgtaaagttcctatttttttctctgtaattaataagtaatttgtatgatactttgagataacaaagtagactgttcatcaaactttcatcaatgaatttaacatccaaagacgcctcaagaatgatcatcaaaagcagcctactaatgactgtcatttaccatttaatacatttcaaacagtgcacgtgctctgtgacatattctgggaaggaacatgttacctgatacataataggtgatcaa

SEQ ID NO: 681 - DNA, 1101 bp, Homo sapiens
acgtatttgcaatccccttatgccataattaaagaaggactttgctgctttgggccaggatctgaacttaggtgtaaaccattgccctggcagagggaacctacccagtccattgctgcctgctacaagatatgaacagtaatggcacatattttggttatgagtcactcagaggactgtggattgaatgaactgtatccatccccatcatgatgtacagaaccaagtctcttcactagtaggtatttttttaattaatatcatgtacacagttatatgttgagattttcaccagagtacctacttttataatgaaaaatgtgtaaaacacatgtattagtgtcgccggtatgaaatatggctagatctagtctatttctgtatcaaccaattgtaaaatgaagaggcatgctgagctgtatctattaggtataagtatataaatgtggtaattatgtatacctatataggcagaatttagaagtatagcatcttccctcttttttaactgaattaagaaacgtcactggacagtttcgatgtcttctggtcaatatcatatagatctggtgccaatgtaagcttaaactttttaccgagtttatgctttgcaacagtttaattttattatacagggtatttgatgtgcttccactcacagatgcaccatattaacagttggtgtatgatatttacggtgttgtggaaagaaaattaaactcagtcagaagatgttaatttcatttcagctccagcatttatcctcatactagtcccctaatctctaggcctcagtttcttcatttgaaaagtgaaaggaatcgtttctgctttacctagttcataagatttcctttgaaggtcaacagaggtaacggatgtgaaattattagctaactctcaaactctgtaaaaataaatggtgttgtctgtggtcaactaacagcacaagtagagagctggaaaaagttgtgaccataattgtctcttccaattaattaatgcagtctactattttatatgctacttgcctaagagataaatgataaaatcctcattaattttaatttatgacccaaattaatttttggtatatttgag

SEQ ID NO: 682 - DNA, 27538 bp, Homo sapiens
acacacagagacacaccgcgacacacacacacacacgcgcgcatacacacagcccgacacacacgcacgcgcgcttcttaaaggagacggctcataaaggattccccactacgccagcagaggggaagaggagcccacgggaaagaaaagcaggcgaggttaagaataaagagtgttccaggatagcacagaagcagagactttaagtctaaacagacctagattcagagccgacccgatgctgcttgaagaaggctggaggtatgttaaggagacaagggctgtcaagaagcagggatgtctctggaaaggttccccttgctgctgccatgtgaagaaggacatgtttgcttccccttctgccatcattgttattcatgttaggctcctgaaaacaccacaaggacctaccctccgggagccagccagagaacccttcttcctgcactgtctccgttatgcccaacatttctgggcataagttttaataaaccttacctgggaaaagtttgtttggcctcgtgttaattgctattatatggagagccaagaatctcgaaccagtaagagttgtgaagtcaccctcaatatttcccaagtcttcaaaggaattgagacactataatcattacccaggactccacgcttgtcaaatttgttgatgacctcctactttgcaaccaaactgaatagaatgcttgtatagactccctaatccttctgaaggtactgactgagcaaggctacaaagcctccaaatctaaatgtccatgggtacagacaactgacttatttaggccataaagcatctcggagcactaaaaaactcacagtaaaatatcttgaaggaattttgacaatcttttcttaagaagaaagaaaaaaaaccagaaatttttagaggcagctggttattgccatcaatggattcttaattttgccatcctagccaagcctttatatgttttcctctcaggtataacctcagaaccccttttatggccctctgagacactggcctcctttgaagcattaaaataagcattatctacacccccagctctcagtttatccaattttgacaaaccttttcaacaatattgccatgaaattaatgagattgttgctagtattctagaacagccgtttgtctctcaattactttttatggcatatttcttatttcgatcaaccctgtgacatcaggcatgcctccatgcctgtgtgcgaaagccacagctgccaccctaatggaaaaagcctttattcttacattaggcctccctactcacctctatgttacccttgatgtgtcagcgctcttacaagctcataaaacacagcaccctctttatacaatggcagaccactgatgaacaggacctattaacaattctctctctattgtatcattgtaacaccctgaaccgtgctattctattactcctccttgatgatggacagcccattctattctacgtgattcctttgtagctatataaatggtctcaaaactatgattttttagacatcttcttagacagtccagacttctgttttgtcatggctgtcaagcagaattctcaccgatacatagtaactgactgtgccatggtttccttaaatgaaacacttgagacaaattctgccttctatataatcagcctgaaccactgagtctagatcttacacgagccttggcaaagagaaaactgacactatttacacttgagatgtgctttggactctgccatactgttggctgtattgaaaagtcccgtttctgacctctgctggtacccctattgccaatggccatgtaattgttaacctattacgcctattcatcttctaattgaggttgcttttgtttattgttggcacatgccaaggagactgacactgtatctctggtagacaatacgtctgacaaagctgccaaacatgaacccccaactctggcaataacccattttttaacccagcttacaaccctgcctttaacacttactgacgtcaataatatttggcagataccctacaatgaaaaaaaaggctgcaagaagattccagacaattgttagaaggattatacgttggaccaaatggacttcctatagtcctttatcttttattgttttgtgcttctatttattgcccatcaaatggaatatatgtgtaaagaagggcaaatcaaagaggtaaatgacagtgattttgccctggaatccacagaatttctgatcaaattatttaccaatgtattacttgtaaatcttatgatatttctggatgtaagtagcataccccatgaaatcctctgagacccacattccctttgcaacactcctggtggactttatagatttccctcaggattcaggttattctcattataggttgactatacctaatctgaaaatccaaaatctgaaatgatacaaatccaaaacgttatgagtgttgtcataatgctcaatggaaatgctcatgaaagcattttttatttaaggtctttggattaaggatgctcatccagtaaatatgatacagctattccagtgtccaaaactatcccaaatctgaaacacttctggtcccacccaagcatttcagataaggaatactcaactcataattggtgattacctgcacagttagtagatggactgagtactatccaactagacatgctgatgccacatggtagtaatgaaaaaaaaaattgagattattcttcattttggcattacttaatgtattaaatcagaccaaggaactcacttaacaacagaagtaaatcacatgttcacaaaaactctaggatagtcattaaaattctatactctttaccatcctcagtcctcagagaggtggaatgtgataatttagacagcaaaagaactataaaatatgtcagtacaatagacctaagtggccagaagcatcacccctgaccccaataaaatctggaaaaccccaaacaagagagatggattaactgctttttgaataatttttgatagctttatgcctattagcatctccaaactttttgttcctgaagtgagtgagcattatggggacctgagtgaaaggttcagtattatgactagatatctaaaagaactatctcttgtacttggagcttaccattaacaggcaaaaaagtcatggccattgtctaccaacaagctttctatcccttttgaccaagctatcaagtatacatcaaaattttgacaagaaagcatacactgtcatctttctgggaagtaccttgtgaagcattgctgaacacctacatggccatcaaaataaaaagaaatatttcctggattcatgcaagtcatgccaagctagacccagatcataatttccagaaaaattgaaaagctattcttacagctgacttcaaaccaaggattttcagggccaattcacagggtcccaaagcagatgacaacataaagtggactattttttccaatatcttggatcaagaactacctttccacctattttcccttgatatctttctcttctctgaccaaaggaaaaaaaagtaaataaaaaccttaaaaacctctttgagctttaaacagaaaccttcccctttatttattgatggactgtctagagattgctacttttttcttcttctgtttcttcacaatgagatattttctaaactgtgtcttgcttcaactaacccttatggctttttttgacaattctagcataaatccagcacctactcgcgccagtcttctaaacactggcaactttcatcaatccgaattttggttatgtcaacatatcggtatacagaagaagctaactagtttttgtttctgccaatgcaaacacctggtggacacagactggactatggatgtacaaaagggtatggtatctacaaacaggaagacaaaaatcatgccacctctctttctggtaaactgatttggcgcttggaaaattccatggaagctcaagttctattctttgttcaggtgatgttattgaatggacaaatttcccttttcattggaaacagaaatggtactggaccctttctagcaaccaacacagcttctcgtttgtaaaacttctcaagatgtttcaaaatggaagaaataccaaaacccacaaagaatccttgagttggtatggttatttttagttgaggacatttgagattccacagatgcagaaaagaatcttctcagagcttccttcttctgattaaaagcagccacttctgggaaataaggctggcataaatcctctcttgagagtggctttactcccagaaacaagaccaagggtaaatctaccataaatcccctctccaggggagtttgatggccataaagaagatgaaaagagttctcacacctgcataaacaaatgttatcacaaactttcttatctcttgtttgttctcccaaaaaactatttgtctttcctaaagaaatccatttgttttccttatagaagtcttttctcccggcttgcttctcctattaagttagatatataaacttctaatttaacttttaggaaactacttcttttgtaagctcttgtatgcaaataaactgttttattctcttgttaatgtgtattttcacagcatatcctccacccagatcctgaatttgagagggtagaggaaaagttttcctctccaacactttcgttctctgtcaatggcttcactggattgctagtcttcctattaaaagcggcaatttattcttccaaagttagtttctaaataatattccatagaattttctttttaaataaccaggtaatacctacgttgacatcaagagagcaccatggtcagtaattttaataccccaggaacatacttttaagtatacattgtttttcaaccaatattggaaagggaaagttccaaaccatactaattggacctacattgaacatggtaaattcctcctcaaatagttgctaatggtttgctgggacagtacttcccatctgtaataactcttaaaattaaattactaatatctttggatttctggatcatcttttacttaatatccaaaaataaattgtgaggtttttttaaatgcctgggtaaaattctgaaatagtagtttatttcaattttgatagctgctgagattcacactagcttttcttcagtcgacacagtaaacaataaaacttcagcaaaactggaaaatataagaacccccaatatatagtcccccaaaggatccagcaggttatagagtccaaagcccttattttataaatgagtaaactgaagacaaaagcaccaatgtagttgcttgaaggttataaaatggcagggatacatgtatgtgtatatatatatatatatatagctccttaaaatgtagacttttgaaagatcagaggatttgaatatgtttacatgtcaagtgattttctaaagctttggctactgaattggctctgagtcagcatggccctttgccatatcaaataagaaaaatcacaaacagatgactaacttacataatgcatttcttttggagcgaggtccttggcaacaggaaagggtaatagtgattttaaacattgactcttcagtgaagaaggtcactgtgtggtcatggatgaggaaagtaataagataatgttgatggcttttctgacttagcatgcctacaagaaatcagaattctgggtgatgacacagtctgtctatcttaagtaatcttaactgggcatcaggccatcaatcttgaaaacataggttaaagctctttgaacattgattataactaagagcagctgactttttcactgcaccataaacctcttatgactctgactcatcagatgatttggaaaaggtgtactcactgacaaagaaaaagagaaaatatagatgagttaagtcactttagtcccagaggaggacaactgagcattaataacattttagaatttattttctgcctggggtcaaatgaccaatttcagacagcatttcaaattctttttttcagcatggcagagaaaagtacatcagagcctcaccagagcctgaatactttcaacccagttgaatagtttatgcaattaattatggcttttaatagaaatgtattcacttttaccttgagaggatgagaggacatcctagaatatgggtgaaagtcctataaccaacacctatgtgataaatggatttacattaggtatttagtccctaacttggcattctacctccttcatcaccaaattttatttcttcaccagtactctttctcaaaccattactcaatgacaattcaggccatataaactcaaacttttgtgatctgcatgtctatgctttaagtttcactctttaccgttctgtcactttaataaatattgatatagcattcccaacccaaattgtacatcctttgaaactttgactaaatgggtaataattatgacaatatttataataaataattataagagcatattatcagcaactgtattccacaaaactggattataaagaaaaactgaaaaattcctgaaaacacataaattagtgaaactggctcaaaaagagatagaacatctcaacagacctatactaactaaagagattgaatcaataattagaaaccttccatcaaagaaaagccctggaccagatgtgttcacacgtgaattctaacaaagagttaaagaagaattaatatgcatctttcttaaacttttccaataaatggaagaggaggaaacattttctaattcattttatgaggccaccattacttggataccaaagcgagataataaaataacaagaaaataaaattacagactaatatctcttacaaatataaatgcaaatatctatcctcaataaagtattagcaaatctaatccaacaatatattcaaagtattattcagctcaatcaagtgggattaacagagaaaaccaagggtgcgtcaatataggaaaatcaatccatgtaatacatcacataaatagaatataggtaaaaaagaaacacatgaacatttcaatagatgcagaagcagtatttaacaaaattgaggagaatttcatgataaaaactctcagaaaacttagaatagaataattcagccatatgataaagggctcttatgaaaaacacatagcaaatataatattcagtggtgaaatggaaggctttacccctaagagtaggaagaagacaagaatgcccgctttcaccacgctattaagcatggtactggaaggccctaccagagctactacaaaagaaaaaaaaaaagagagagagaaaaagcatttatgttgaaaaaaaaatcaggttaaaaccatctctatttatagatgtcatggtcttatacctagaaaatcccaaagaacctagtagaaatccccaatagctaataaatgaattcagcaacattgcagtataaaattcaataaagaaaaatcagttgagtgtttatatgacaacatgaccaaccaaacagaaaattaagaaagcaattctctttgcaataaagtctaaagtagttaaatactgaggaatagatctaaccaggtaggtgaaatacttgtattttgaaagttatgaatattgctgaaagaaattaaataagacatgagtaataaagatttgtgtttatggacaggaagacttaacattattaatgtgttaatgccacataaagtgatctacagattcaatgcaatccctatacaaattataacaggctttttcatagaaatgggaaaaatgccctcaaattcatatggatttttaaggggccccaaatagtcaattatataaagaagaaaaataaagctggaggactcacatttcctgactttgcaatgtaccgtaaagccatagtacttacaacagtatggtgttggcataaagacaaacatgtagactaataaaatgtaatagaaagcacaaaaataacccctgcatacttagtcaaattatctacaagtatgccaaaaccactcaaagaatgaaaggacaatcttttcaataaaaggtgctggaaaaactatatgtccacatacaaaagaatgaatttggatccttaccttacaacatatacaaaaattaactcaaaattatcaaaaactgtaatagctgcaactacaaaagtcttagaggaaatcattggggaaaatcttcatgacactggatttggtaatgatttcattgatatgataccaaacacacaggtaagaaaaaaatacagtaaagttgaacttcatcaaaattaataatttttgtttatcagaggacactatcaaaaaagttaaaagattctggttgctaatattttgttgaggaattttgcatctatgttcatcaggattattggcctgaagttttctttttttcattgtgtctctgtcagattttggtatcaagatgatgctggctttgcagaatgagctatggaggagtcctcctcctcaattttttttgaataatttcagtaggattggcactagtttttctttgcacatctggtagaatttggctgtaagtccatctggtcaagggctgttttggtttgtaggattttttaaattactgattcagtttaagaacttgttattggtctgtttaggtttctacattcatctcggttcaatgtttccaagaatgtatccatttcctctagatatttgactttgtgtgcataaaggtgttcataaatgtctctgaagatcttttgtgtttctgtgggatggattataatgcatattctcatatataagtgagagctaaacatagagtacacataaacataaagatggggacactggggaataatagagggggaagagagggagaggaacaaagatgaaaaactacctatggggtactatgctcactacctgggcaaggggttcaatcatagcccaagcctcagcatcacacaatatacctttataacaaacctgcacttatacaccctgtttctaaaatagaagttggacaagaaaaaatgatgcgcagtataaattatttaaatgttttgcagaaagtttatacaatttatttcctactagtttactgtgatttttttagataccatgattgctatgaatgatggtaacttataaggtggtcacaggaatggaagtggataaaaggtgatgaaattgagacatggaagccaaaaccaaaaggatcatatattgatgtggttttgggaggttaagagatgacaagattgattctggcttctgctactgggaaaatgtttgttttctggtttgtttatagagaacaagagagaaaaataaaaataaaaaaacaaggatatgcccccccttaaaaagttaaaaaagttaaaagaaaacctgtagaatgagataaagtatttagaaattaagtaagtgatacaagattaatatctaggacatataaaacgcacttaaaactcaacaataatgacaataacaagaaaaaaagttcaaaaaggccaaagcacttgagcaaacacttctttaaagatacacaaatggacaataagcacttgaaaagatgctcaacctcgttagttattagggaaatgcaaatcaaaaccaaataagataccacttcatacctactaagagggcaactacaaaaacccctgaaaaataacaagtgttggtgaggatgtgaaaaaattgacaccctcttgcattgctggttggaatgttaaatggtgcagccactgtgggaaacagttcagcacgttctaaaaaatgttaaaaatataataatcatatgacccagaaatttcactactaggtatgtatccaaagcaattccactattaggtatgtatccaaagtaattgaagcagggaagagaaacccatacagcaatgtccttagcagcattattcataatagccaaaaggtggaaacaactcaagtgtccattaacagataataaataagcaaaatgtggcataaagacacaatggaatactattcagccatataaagaattcttttcctactttattgaaatatagttggcagttaaaaatgttatatatacacacacacatatatatagagagtacaactagatgatttagtgtatgaatgtaatatatgaatacattccgaaatgttatcacaatgaactaaattaacatatataacctcacatatttacttttttgttatgaaaacaagatttatcttcttagtaaatttcaagtacacaatagaatactattaactatagtcacattgttgtacattagatcttcagaacttacttatctcacataactaaaactttgtaccccttgatcaatatctccccatatccctttcctccagcccctggtaactaccattctaatttttgttttatgggtttgactttttcagattccacatgtgagcttatgctgcatttgtctttctgtgtcaggcttgtttcacttagcataataccctccagttgtatgcatgttgtcataaaaggcatgatttctttcttttctaaaactgaataatatttcaatgtgtctgtatatgagtatttacagaaatgtaattatttttgtattttgattttataacttgcaattttactaaaggtgtatcagttctaacagtttttaaaaaatatttacagttttctacatatatgattatgtcatcaacaaatagaaatgattttttatttggatgccatttatttctttttcttgtctaaacgctttggctaggtctttcagtgctattttcaaaagaagtgaatagagtggaaatctttaccttgggccatatcttagaggaacaacttttgtgtgttccccattaattatgatgctagctgtgggcttttcatatatggcttttattgtgccttctaaaactatagacagtcctccatatccctgggttgcacatctctggattcaaccatggagagaaaacatataatttgtgggatgcaaaatttgcagatttgaaagggcgatgtttgtatccgcagttctgcaagtgccgaccgtgagacttgagaaaccatggatttttatatccacagaaggtcctaaaaccaattcccctcagatactaagggacagttgtattttgctaattgttttaatcatgaatggatgttgaatttcatcaaatgtgtttcctgcatctattgagatagccattttttaaaaattttattaatgttttatatcacactgatcgatttttgtatgttgaacaatccttgaattccagggataagtcccacttggtcatggtgtgtgatgctctgaatttagcagaatttggtttgcttgtatattatttagtacttttattttatgtttattagaaatatattgtggttttcttttcttgtaatgtttgtcttattttggtatgagggtgattctgaactcataagtttggaagtttttgatcatttcctatttttgggaaaaatttaagaaggtttggtgttaattcctctttgatgtttgttagaattcatctataaagccatctagtcttgggtttttatttgttaggagatacttgactattgctttaatcttcttaatttttttatctgttcctgctttttatttcatcttgattttattttgttaggttatatagccctaggaatttattcatttattctaagttatgcaacttgttgggatatgattattcataatattcctttatgatcatttttattcctgagacatagattgtagtgtcttctctttcatgtctggattttattatctgagtcctctctcattttctcttagtctaacaaagggcttattttttctaaacaccagctctggaattgtttcttcttttctattttcataaaatctctattgtacttatttgtgatctactcttgattgtttcctttcccccacccccccatgacattaggttagtttgttgttatttttctagttatttgtgatgttaagttaaagtgtttatttgaggtcttttttcttttataaagtaagtgtttatcactgtaaacttttctcatattactcttgtacttttattactgcttttgctttatctcataggttttggtatgttgtattgtcatttttaattctattttgatttcctctttgacccaatgattgttcaaactatgtgtttagtttacaagtatttgtgaattttccagttttcttcctgttattcgttttaagtttcattctattgtggtcaagaaaaaatacttggaatgatttcaatatccttaaatttgttaaggtttattttgtgaccttataagtgatctatactggggaatattccatgtgttcttgagaagaatgtgtattcttatgctgtttgttggaaagttctgtttgagtgtgttagttccattggtctacacattgtagaagtctgttgtatctttcttggttttttgtctaaatgttctattcattattgtaagtggaatatcaaaagtcccctgctgttattatattgctgtcaatttctgtcatcagatctgttaatattttcttcacatatttgcatgctttgatattgggggcatatatatttatgattgttgtatctccctgttgaattaatcttttatcactatataatgtttttctttgtctttagagacaggtttagaattaaactatattttatctgatataagtgtagtcacacctgctttcttttcattatctattgcatggaatatatttttctattccttcacttgcagcctatgtgtgtctttaagtctaaagtgagcctattgtacacatatctgtgaattttttttctgtataacccctctaggccttttgattggagagtttagttcattttcatgtaaggtgattattggtaagtttggccttactattgccattttgttcattcttttcgatctatttttcatttgtttctctattctttttcttctcttgctgtcttattttgttatttaataattatttaacattttactttgattattttctctttatcttttgtatatctattacagatttttctttgtggttggcttaatgtttgtatactgtatcttattctgagatactataagttgtatcttatagttaagccttctattttaagttggtaacaacttaacctcagttaagaatgaagttaaaactacagttttactttctccttcagctttgtgttattgtagtcatgatttgcttttattaatattgtgtatgcattaaaaaattctcatcttttaacttctatattagaattaaaataaattatgcatcaccattaatgcgtaagaatgagctgtatatggttatatagttaccttccccagtaaaatttatgctttcatatgcttttgtattgttgtttagtatgggtttatttcaatttgaagaatttatttaagcatgtcttgtaaagcatgtttagcagtgttgaactccctcagttttagcttgggaaagtttttatctctcctttctttctgaaggacatatttcctgatattctcgaatggcaattttttatttcagtactctgaatatgtcatcttattttctgctggtttgtgaggtttctgttgagaaatctaccaacagtcttatagagattctcttatatgtgatgttatgcttttttagtccctttcaacatttcctttttgtccttgactttagacaagttggccataatgtatctctgaagatcacttgatgttcagcttatttggggtttatgggcataatggatttggatgcctgtttctctgcacactttgaggaattttccatcatttaaaaaaaattagttttggctcctttctttttctccactctttctgggaatttcatttatatgtaaattgtttcacttaatggtatcccataagttatataggctttcttcacttattttcatttttttcttcttttcattcctctaactggataattttaagagatctctcttcaagttaactgattctttcatctgcatgactgagttttctgttggggctctctattgaaattttctgctccagaatttctgtgtcttttaaaattgtttcttattatataacttctaattttgttcatgcattgtttccctgattttgtttagttgattttctttattctcttgtagctcactgagctttcctaatatttttttgaattcttggtcagggaattgataaagctccatttttggggtggtcagttactaaaaaattattgtgtttctttggtggtgtcgtgtttttttactttttttgtttattataaccttgcattgatgtcttcctattttagggaatagtcacctcttcctcactttacatacttctctctgtgtgtgtgtgtgtgtgtgtgtgtgtgtgtgtgttggaagctattcacctattggtgggtacaagggcactggctaaaaagtgtgtggtagcctagtttccatgcagctccatcagctgaggtcagtgtcagcatagactcagggagatctcattagccaaggctgtgggcattcttttactctcctgacatagctaggaattttgaggtccttaatggtgaaggctgttgcagttctcttgttttattttacctccacagggtgaatttatggctgagggaattcattatggtgctggttccagcatttgagtgtgcttttggtggcagtgatgccagtgtgtgaggcacaaaattgcccagaatggttgcagaattagggtcggaagcatgagcattaacagagtgaccatggccagagactatggtgtgggcttgccacctgtggtgctcctgtcagatgtgggcatacatagagtgggtgcagagacaggatcctaaacacagaagggagtagagtaacagcaatgctggagtttgaatgtgcatgtttttgcagggggatagacgagtgggtgctggttctggcccagggtggtgaagtgtttccacagcaactttgatggctactgagctcctcagcagcaacaactgctagagtcttcctgcaggccactggggaccatagtatcacttgctgcatggctgaaactgtttggccctgccctttttctttgttttcagcttctccagacatctcatctatattgatctttctggtagtctggttggtatacaaccaaaatggacccttcaagcagtgacccaaaaggccagggcagctagtcatttgccctactttctttttcaccatgagggaaaatcatgggctgagagtttcttttcgaggctgaactgtcccaggctggaggataggacgatgcaggcaaaaaaactctttcccctattttttctgtgtagttattttttttccttcaatgtgttgctgcagctttttatctgaactgaactcatccagatctattttcatccaaagatagctgtctaattgttgtttctacggggagacaaaggttggggtagcctacttcaccacattgctaatgtcatggaaagaatacaattttgatataagcttcaacatggataaaccttgaaagaattttgcttagtaaaataagccagatacagaagataaatattgtatggttccatgtttgtcagatacttagaataaacaaattcatagaaacagaagggagactataaattactaagggttgaaggggttgttgaggggagaagggagagttattgtttaacgggtacagagttattgtttaatgggtacagggtttatacaccaaaccattctagtgaatacattaaaaatcagaaaaggaatatacacacctaaaacacttatcaataccagactataaattactaagatgaaattgagagctattggtgagttggggatgataaaacatttgggggtatagataatagtgtgggttgacagcattgtgaataaatttaatgcaactaaattgtatatttacaaatggctaaaattacatcatgttttatatatatttttccacaataacaatgcgatttatcagtttcataaatatttggaaaaaataataggggatactcatacctcaatgaataattgtagatggtgtcaaggtttatttctattttgttcttaccttcagggatcttcagtcaagtgaggaagatagtcatatgtttaaaaaatggcttttttcctgaaccttgttaattccagataattctactatcatatcaatatttctgtcttttcatgctatatcttccctgctttatctagcagacagttgaaacaaggaaatgagggcttgtagtatttgtgtattagactcttaagttaatccctattttgactacctttcccccttcaaatcttaaataggatataatgactgatcttaggaatatactatagaggatcttatcttatcttatcacatctaatgaaaactgatagcactgaaaaaatatttaactacatattgtacccaaagttaaaatgtcttatactgtcagataaatagttcaaaaagggctatagtcatattttaattagtaattttcctgtcaactataaaatatcactgtcattattcagaaaattgtctcatagtaacaaaatctataatttcatagtaatactttcacttgacagtcacattcattttctctttctctaagggatagtattacaggctttgaaagttaaacataaaactatctttatgttttgtgaacactaacataaaaactattctaataagatagcttgtgaatatataagctgtgtttatatactgtgccatcactatatgtttacatgtttataaaatcttttcatttataatgacatattatgttctagagatcattatagaccatttaagaagatatcttgtaggtattacaagcttcaaaataacacaaaagtacatttcattttttggcaaaacacagcattttcatgataaaatatcttataatgcatacataaaaaatagagaaatacactgcatttttgagtgagtaaacaagagaagatatatgtgccattggcaaagagtgttctgtttaagtttggtttattatacacaatgaattagtattttttagcttccatatgctatgccttattttaatgttcataatatgatcttgaggaagagaaaatatgctgaatgcctactgaattgctacataaaaattagatttgcttcagtgtaatgttatcgataattatattattgtacaaacattatatgtcttctgaactcctgtgagaactcatcaatacctctcatttgcatcttagtaatttatagtctggtattgataagtgttttaggtgtgtatattccttgtctgatttttaatgtattcactagaatggttttgtgtacatggtgctgactacacatagttaatcaataagtagctgttgatttgaattcaccttctaactctaatcaccagaatacctacaggaaagctccattccccaggcatgtaagaaaatatcaaggttacattaattttgaaagtgctaatctggaattgattttcagttaatgaggaaatgttttatttctctaggctttctaaagtattggatgttttaaatttgtttaatctacgtatttgtatgtgcatagttgataatttctttatttttaataaacatgggctatagatttttcccactagaagtaagctacattataacagtaaatatctttttcattttcactgttatatatccagcacctttagcaggaacaagtagatgctcaataatattagctaaatggaagacttaagaatatatattcagagtataatttcatgctttctgtttaaaaaaataagtcagagatatatttcatgacaatactgaaataacttcactaagaaatgtagaacaccggacatccagacaaattcatgcacacaaacacacacactattttaaagaaataaagaaaaatttttagatagtgacatatatccttaagtaaatatgtaattagtagaggcttctatcaaaattccaatgcaattttttcaggaattgatcacatttttgtaaagctcacggggaattttctgactcaagatcactgtttttttacatctcctttcatcctagatctcattaaaatagtagaataagtatttttaaaaataagcataaaacatagaaacattggaaggataagaataagctagaaggagaatggaatactgaagaatttcagataaatatgatttgcataaattaatagcaaaactcattagaactgaggaattaattctacacaggcaaaaaggcagacatctaaaacaacaaaaatttcccaaaagaattttggaatcacaagatcaagtcaagcaagtatcagagaaggactgggccatttgtcaaggacgagattagaccaaccattgcttgacaatctgagagaataacttgggcattgctcacctagtagctaaaatagtatggtggtggttaaaaacactgacttgggagtcaaactacgggattaagtaccacatcttccacttgttatctatgtaaacttgggcaaattttataatctagcaaatttcaatttatccattggtatataagagataattgttcatatggagttgtgagtattaaaaatgttaataaatggaaagtacttagaatggcacctgaaatatattaagtgcagtattagtgtttgctcttgttatttttttaatgggatttgagtttaaactacaagtatggctctctgcagtgagaattttaacataggctatacctagattggtcacttgggaaagaaaaacacaatagaataccaagtaatttaggactgccaagagggaaaggattttctatcacccggccgggcccggtggctcatgcctgtaattccagcactttaggaggctgaggtgggcggatcacgaggtcaggagatcgagaccatcctagctaacatggtgaaaccccatctctactaaaaatacaaaaaattagccggctgcggtggccagcgcctgtagtcccagctacttgggaggctgaggcaggagaatggcctgaacccgggaggcggagcttgcagtgagccaagattgtgccactgcactccagcctaggcaatagagcgagacttcgtctcaaaaaaaaaaaaaaaaaaaaaaaaatacaccccccacacacctcgccccagttgcacaatgtgcaccctcattattaggagcaagctttctgtagcaaatacctgaacttcactaaatggtgaataaaaattcttcctcattcaaattctcatccatacatgccagagataaatactactctgcttatatgacaaattacatatataataaataattaaaaataagcattttattctgcctagcacaaagaaactgaaatagcaaacagaaaattagcccacccaaagaaataaaaagagaaaacagaattattttaattgactactgagaaaacgaaccccaccaaatattaatttagaaaaaagaagtgaatagcagatttgactcaattaaagttaaaataagtgagataaaagaaaggacttaatttttttataatcaccagagaaaaagtatacagaaaaggtatgtgatataatggctagttcaagaattccaactattcgttagtataataacaaaataacagaattgagagaatgggcagagaaaatcatcagtctaatagaaggacattttccaaaataaaagctccagtctttggaaaaaagttattgtttgacattcaggattaacacaagaaaaaaaagtttgacattcaggattaacacaagaaaaaaaattctgcaagaagtcatatcctagtaacagcaaaactaagaatttgaacaaaacaaaaatcataaaagctttttcagggaaggggtgtgtttaccttctaaaggcaatggtcagtaaactacaactacagataatgggctacatatttctgttaataaaatttcactaggacacagacacacccatgaatttacttattgtctgtggctgtttttgcactacaaaggcagaattgagaacttgtaacagagaccatttaaccacccctaaaaattcaaacctagtgtatttactacctgacgctgaagaaaagtttacctacggggttctgaggaaagatgaattatgagctgcaagactaggtgcaagaagataatgaaagaaggcctttcaagttctacagaaagttttgaaactagtgcacaataaatacaacataagttggagataaaccaagaaaaattgacaaagccataataaacttgagtgatattaataaataggtccctgaaactaaaggaaatcagggaaaataggtcagtcttctctattagattcacttctgacagaggcctttggtacaattgtctctgattactccttgcaaactactgatattttgagaatgagatattgtgaagaacttcagccatctgacccaagtctattgattctctctccctttttgtcaatccctattttcagggcatctgaatttttcttctgtctccattgttatgcttagcaaatttccccaaacgactggatttctatgatggcctcatgatgattttacttctacatatatataatctattctgctcacccaagaacagattccctttgtttcttaaatattatttgaactcaagtgggttggaaatacctatagtactctaagaactcacacttagttccttcttgagaaaatattactgtttcaattttcttggtctctgctcttttccttgcactcctttctccactcagccttgtccctcattgacactcagcacactaaaaggctgacgtccccacatattttgatctcatgtcaatcctctgatgggtgccaatcttaatggaagtatatgagggaaaggcagggaggcaccacatactgattaactatgctttttgaataaaaatctatcactttggaaagcttaacttacaccattaaaaatcaattaaatgaacttttgagttgtgaaatttaattttctcttactatatactgtttcctaaaattttgtttgtaaaaattagatcctatataaaaattgagtcaattagattgaaagctggcttcaagatgataaagaaaacatagtaataaatttggagtcttaatttgcagatctagcaaatctgtggtctgtttttccttggcctcttcattaatattttactgtatgaaattgaagtgaattatcacataccataggcaatattgaaataggaggtgtttcaagcagtgtaaatgagaggaaaataattacagaacattaagtataaggcaaaaagtctaaaaataaaaaactatcaaattgagtaaatcaccattaatgattgttttgaaaagattataaaagtaagcaccactgaaaaccttgggtttacccatggcttgcagatatgtgaattatgagatttattataattagagcaatttattataatatcaactatgtgctggactttatctactatatgccttatcctatgtgttccttataacaaccctaggtaaaatctttttaaatctctattttaccaacaacatcaaacaactagataaagatgaaaccagaaatttaattttaatggtctgaacccagagtccacatttttaaccactatttacatacctattattagctcatattatatgcatcatggttaatccttctatgaagggaaacaagtttcacacctgatttgctgcaatagattataggcgttgctatggactgaaactttttgtcaccctgaaatgcatacattgaaattccagcccccattgtgataaaattaggaggtgaagctttttaccaataattagcttatgaggatggaatccttatgaatgggattataaaaggtatcccaagagccaggcaacgtagcttgtgcctataatctcagctacttgggagcttaaggtgggaggattccttaagcccaggaattctaggctgcagtgagctatgatcatgccactgctctccagcttggggtggcaaagtgagactctgtcttgaaaaaaaaacaaaaaaaaacccaaaacagcaacaacaacaactgtagagagttttcaacccctcttttcctctttttaccatatgagatcttatagcaagaagttgtcagtgtgcaatctggaaggaggccctcaccagaacttggccttgctgtttactgatcttggactttgagtctccagaactgtgagaaatactaagttggtgcaaacgtaattgtggtttttgcatcaacctaataaaaaactgcaattatgtttgcagaaacctaatatatttctgttgtttataagccactcagtctatggtactctgttatataagcccaaactgactaagacaggtgtacaacaagatgttgaacttctcaactttcaggaaaacttgaagggttttcagtttgtcagaattcctggaaatgtgtctgtcaatgagaagtaccccatagatagcagagcaccgcacaggcagatgaacactccatgatcttcacagacagtgagcagaacaggtacttgctgatactcattaatatcctgggcttggccaagaaaatgctctattacctggatagctactcaacaattgtaatagattcagaattcactactgcccattacccacaaggaactggtgatgctgctgaagggggttgggtttcagggatctgtagagcataacaaacaggcaaactgtctcatgatacacatgactatgggtggcacctccaaactctatcgttgaatattgtagtggatagaaaatggtggcagtctgtgctctctcctcttgaatctgggtgaatttgtgactgtttcatcaacagaatgaaacagaagtgatgcctagtgtctgagcccaggtaataaaaaactagcagtctccactttcctgtcttttggaattgtagctcttggaacccagtcatcattgtgagagaagcctgaggatctctatgaagatgactacatagatgtaaactaaggcccctggctgacagcacctggatgagcttccagccagcagccagtattaaggtgtcagccatgtaaatggtcttcttgaaaatggatcctttagttgcacttaagctattgtagctgataccactggggtggggctgaggggaggggaataagccatccttgctgaaccctacccaaattgcaagtttgcgagaaaactaaattaatattattgctttaagttgtaaaattaagggtggctttttatgtagcaatagaaaactggaactaatagtgctatttgaactcaccccagagttaatttctcagaaagtatacaaaactttgcaaataaaggcttcattttactgtgaaatcatttatatgaaaaattcagttacatttaaaatacattcacattataacagtacatttaatatttattaataaaataagttattcaactgtaaatataattcaattgaacaattttgcatggttctaaaatgctttgtatgtctttccttcttcttttctttttttgacaaagtcttgctctgtcaccaggctggagtgcagtggtgtgatcttggctcactgcaacctccgcttcccaggttcaagtgattctcctgcctcagcctcccgagtagctgagtctacaggcacatgccaccactcccagctaatttgtgtatttttagtagagatggggttttaccatgttctccaggatggtctcaatctcttgaccttgtgatctgcccgctttggcctcccaaagtgctgggattacaggcatgagcctccacgcccggccaatgctttatatttcttatgcacttatgcagagttacatattgctgacaactaacaatattttgaaaggattattataaacatgtaagcaaacttaagacctgatgttttaaaaacctccaaaatgttatgttcatggatcaagctcaagctgctcatgaaactatttggaagtattatacaaactaatacagtattttacccaagacttgaattgtatttttctaataaatatataatataaagattacattttgccgagctccacataaatacccacaaattgccccatgtttaatctcatgtgccatacatgaaaaagtttacaaatttctgatgtaaataatgttgttctcattttaaagcttaggaaacacacatagaaaatctaagtacatcacttcaaatcacacaaatggtaggttgtaaaaagagtttgaacacaatcagtctgtttaaatttcaagcccatgctctttctagtacgttttttgttttctgaataatttagctttgagaaaatcggttgacccttatgttacagtaatgtttaataatatgagtatacaactagttttgagctgctcatgcatcaaaattaaaaatgataataatataaacattttatcttgttgagcctagatttagtcagtatctttgtagatttagcaataccctgcttcacattgacctgatactcattaggcaggggaggatttgcctctagtatagttttgatcaaagccagtcacaaagacattcaacccagggatgtaaggtaaatccgcaaggtaatgcctccaaatttacactgttaaaccctggattgaaacagcttttgtgtgagctttgttaaccttaacaaatagcatttattctgagtacgcaacaggaaaaaaaaaaaagcagccctttgtgcatgtaattctgttacattctctacttgcaaattgattatattctcctgcatagcaacacaaaaatcatattttatattgtcttgttcttgaaaatatcaactaattatgagagtcagtgtagtagctatattaattaaaacaaacctattattttaaaacatctaatcactttcacacagttttggaaatgagatatctttctagatttattccctttcattactccaatttaggattactggttgttggtgatggtagcagtgttcatgattcatggtgatagttgcagtgtggctgtgtatttgcgattctgtatatgtgtgtatgtttctgctctccaatttaatttacctgtcattttgttgtatctatattttcactacatcacaaataagatcttagtgaataataagcaacaatacatgttgacgaatgatttgcagaagagcaggatgaagggtggggaatgtattatggattaagcctgtgggtttctatagcttagtagaaactagttgtcaaagtcactacctctacaaggacttctcttgagaagggccaaaaaacagagcatctttcgccaagaggtgaaatttgaatgggagaggcccttactcctctcgttctgacttaacaagtctttttataagaccaaaaaaatgttgaacctaacttacaaaaatccattgttttttttttttcgagacggagtctcactctgttgcccaggatggagtgcagcggcgagatctcggctcactgcaagctctgcctcccgggttcacgccattctcctgcctcagccttctgagtagctgggactacaggcgcccgccaccacgcccggctaattttatgtatttttagtagagacagggtttcaccatctctatctcctgacctcttgatctgcccgcctccgcctcccaaagtgctgggattacaggcgtgagccacagcgcccggcccaaaaatccattcttaatggctttctcttctgatgcaaaatcctgattgccttcaaatattactattagatagaaatctccccacctttagctgaaagagataaggaggttttgcactgaggaaacaaacaaacaaacaagcaaacaacattcatcaatttttaaaaaaagtatgtattgaactatagtcaggttcaatgaggaaatgcattacattgtcactaaactggccttagttggagaaagaacactggcagattaattaaagttattagcgcttatggtaggaaactgcatgatatatgtgaaagatcttttagggactggaaacacagtgtaaattcaaactcctcccaaaactttaacaaggctggatgaaatgaaaggaatactgtgatttctacaattgacaacagtgtcaggcatgcaggaaacaaacaaaaccttttgatgaaggaaaagtaacttctggacaaagtataattggttacaggtaaacagatatgtcatccaggcagatatgacagtttataggaaaaatataatgttatgatctaaaaaatgcaagccacaaacctattgcctgggcaataattagcctgaagttgggctactaaggagctggctaagcagcagtgataacaccagatactggaagaaacttctgtgatcagaaaccaatacaactagtgaacaattcacagtatttctaaatccgggcaccaaggaagttgtttggttagtcatgatggaagccaggaacaaatagatctcaaatgtgtgataataattatcaagcggaatgtctagaatattatagtgagtgccaagatttccatctaagacattaccaacatagcaactgaggcatgaattacaggttttacacaaaaaaagcattataagaataatacatataatatattaacagttcaaaagtgaaacaaacatttatgaatgggctactcagatttaaaataaaatattgcctgttcattgaatgctttctggattttactttctaattgtatacctctctttctttcttaagataactactatcatatatttgttttggactgcatgttaataaaattatataatatgtattttattaacttcataataaaaatactttttaaaataatatattgagattaatccctggtggattgtgcaactgtatttcattcattttcactgctttgcattcaattcaatccatgtacagcgtacccatctgttttactgtcaattgatatttttttctagatttttaaaatgacaaagcagcaatgaacattgcaactttaaaatttttggacctgtttcctggttcacatgtgttaagagtttcttcagagtgtgtaccttgaagtggaattattggattgttttgtttttgcatgtgaaactttattacatattgccaaaagactttcaaaaataatagtgccaacttgcagtttaagaagccccatgtgaagagacttactgcatgtacatacaacatttggtgttctcaaaccttttaatttttactgttctagaaaatattcctttttaaaattgtatatttctttgattttttaataatgatatttgctatccttttaatagggttttttttggccattatttgttattcttctctgaattgacttcttatatattttgttcatttttcttctttttttttttcttgagatggcg

SEQ ID NO: 683 - DNA, 2572 bp, Homo sapiens
gggtgggagtgaccaggtgccgtccatcacccctttctttgattaggacagggaactccctgaccccttgcgcttcccaagtgaggcaatgcctcgccctgcttcgggtcgtgcacggtgcgcgcacccactgacctgcacccactgtctggcactccctagtgagatgaacccggtacctcagatggaaatgcagaaatcacccgtcttctgcgtcgctcaggctcgaaagcactgtattttatggcgaaatgttgaaagctatgcttgaaatggaaataggtgcagtggatgagatactgtttgataacatgagaagaccaacaagatcagaacagaaaccctcaggctacaaatacatggaaatagcaaatagtgccaccacgcccagctaatttattttgtatttttcggggtctcaccatcttggccaggctggtcttgaactccttaccttgtgaaacacccaccttggcctcccaaactgctgggaatacaggcatgagccaccacaccgggccaatacatagttttttataaagagatattcgcctgtgaaagaaattgaatccatggttgtcagaagtgaatagaaagttaaaaaccattaataagttaatattttcattaattcaacaaatatgattgagtacaatgagatcccaggcactattcaggatttccacagacatgaatgaaacaaaagtcttcctaatgtcagagctaaagtaataaacacagtacttttcaataaaatcacagggattattggacaaggaatgagtattcacacctatattcttttcttgaagacaagaatgttcaagcacactgaagatgaggaactaaaactaagacaatgtaaagaggtcaaatcgactttctctataagcaaagcaaaagcatcatcagtctaccatgactctcagtgaatcaaaagctatttatcagaaaaaaaagtacattcggccgggcgtggtggctcacgcctgtaatcccagcactttgggaggccgaggcaggtggatcacaaggtcaggagatcaagaccaacctggctaacacagtaaaaccccgtctctactaaaaatacaaaaaattcccgggcgtggtggcggttgcctgtagtcccagctacttgggaggctgaggcaggagaatggcatgaacccgggaggcagagcttccagtgagccgagattgtgctactacgccccagcctgggcgagactccgtctcaaaaaaaaaaaaaaaaaaaaaaagcagaaaaaagtacattcatggcttgtatctcaggtatatgtgggctttgattttttaaccagtctggtaagttgatgaaagaaatccctgctaaatatcagctccctacaaaaaccagtgtactatctgttgacaatgcaaagttaagttcattaaaagtaccacaataagaaagaactctactttgaaagagtcttaaaaagggcaaattatgaatgaatgtttacatggttgttgaatctgagctttggttgtcttttaaggggactgctttttgagattggataattttgtcacataatcatttagggttgtttgacttctttaagacagaaaccttgaagtaattcttggtaagaaaattgttagattaatatttaattgctcggatagcaaacaatttggttagataaattggtttcattactgtcttaaatattacagtgagggtttatagtcttattcttgtcctcttaagcaaaaatttcccagaccaaagactcagccctgatcatttgtcatcctgaactagaggatatataatcgtcatctgtggagatgatcagtccagatccgaactgctgattgaggagtggccgttatgtgttatgtttctaatggtgatcacttcaacgtctaggaacatcaggttttcttatcccttttctggatgatcaattgtggtttttaaaatttttttttatctttttagtggggcagcaaatgtgcaacagcattcagactttgcagagctcatctctaaacaaaccaacatgaccagcgtaaatatctatattcagagttcatatccaattctaagccagaatccaagtgtgcctaaattaaaacaggagttggattcaatctccaacctgaagagaacagaaatctacatattacattattctattatgatagcacatgtttcacctgttgagtataactgtctgcccaatcttattaaatttttatgtgatgttttctaaagctttagtgatattttcttgattccctgtcagtttttgaactggatggtttcccctgttttccaggctttgtgtaaaggataaggaggaagatgcttgaagaaaaaggaaagcaattcaaaattacctgtgagtggttaaatttgtcagatatcaagtaaacatgaggacaggtgattgatgataaaaggagctggatattgatcaagaaaaaatgtgacaaattccacatttgatttaaatgtataaccactttacatttcctcactatctttctttcattgttaatgtccataattctaaaaaataaagttatattgtta

SEQ ID NO: 684 - DNA, 2464 bp, Homo sapiens
ccgaggccggccacaagcccacggtcccttctgcacggtccctgccgcgctggggccaccgtggaggcccggagggccctgggaggagggaggaggagcagaggctttcgggagaacccagcccttcaccggccaggggaggccgcgatgcatcgcgactggttgtgaagagccaggggaagaactttaccgtgcaggtgagtgggagacatcagaacacctgcctgtcctaaatacgaagcctcgaatcctaacctataaaaggttaccttagggtttagggttagggctacagattagagctagggattaaggttagagttggggttggggttagggtttaggggttagaagttagttttggggttaggagtggggttagaattagggtttggggttagtgttaggggtaggggaaggattggggtagggttagggttgggctagggtcggggtaggggtagggttttacggttagggtcagggttttagtgttggggttagggtattggggttagggtttgggggctaggggattagggtcaggggtgggggttagggtttgggatttggctaaggtttgtaagggttagggttttagggtaggggataggggttagggttacgtgttggggttgggattagggttaggggttacagtttagggtaaggggttagagttaagggttagggttagcattaggagttacagttgggttaagggttaggggttaggcttagtgttgttagggttagcttcagggttcggtgtcagggtttggggtggggtagtggtaggtttaggggtagcgttgtgtgttaggatttgtggttacggttcgggctagggttttaggggtaggcataggttcgagtttgggtttgggtgttaggtttatggctagcattagggtaggggttaggtgtaggagtaggggttgaggttatgagttgaggttagggttaggggtcaggggtccggtcaagggttggtgttggatttagggattagggctagaattaggggttagggttaggggtttgtgtcggggttgggttggaggcttgggttcagggtcaagtttagggttggggctagggcttagggttatgggttagtgttagcagttagggttaaggtttaggcttagggtttagtgcttgaggtgggggttaggtgttaggggttagggttaagggttagtgttttgcgttagtggttagggttaagggttatggttaagggtcagcgttagggtcaggggttaggggtaggggttgtgcttagttttagggttagggttcctggacggatggttttcctgcttgggaatgttcctgggctgtgagatccactcttctgggcaggtggttagcacctaacgttttccccttacttccccccaaattcttaagtcctttggtccatttcattacttcttttggggagggcctgattcctcagggcctcagtggcagaaccagcctgaggtcacctccctgtccatgggttaccacggcccctgggcaggcatggggagctggggtggcttgggttcctggccttggcacctccctttgggcggctctggagtgtggctgggctgttggtacaggagccacaggccactgcctttttggctgaggggaccctaacatcctggagcaggtggggcagggcccatggtctcctctaggtgggaggtgggaggctgaggcggcgtgggcaggcaggtggatggcgaggcagcatgggcaggacggtggatggcgggtccacaggggcagccagcagctcctgcacccactggggctccaagactgtgggcaagggaggaagggggagcccaggccggaggatcctgggggacggtgcggcccgggggccagatgtggtcaccgagcccagccaggcctagggccgcagcagccccagggcactgagggcgccacccagcccgacacagaggcacaggccgcccgtgggtccagcgcccgaagtccacgtacagtagctgtagatgccgagccggtcctgttgcctccgggaacccagtcctcctcgtcctccaggccgcgttccccgggtcccgcggcccttctccagcctgagcccgccgccccggccgcagccacgcgcagggaggagcccggggcaccatagcacagcgccggcctcacacacaccctcgaggcccctctcgagcccccgcggagccctccgcggccgcacgcagaggaaggctgcctcctgtagcagagcccagccattcgcgggtgcccagttcatcttcatggggctaaacctgcgggaagagagggaaagggcccttagtttccatggagatcgggtgcccagaggcggagggctcaaggctggagagcagagggacccccatcttttgtgggatcagggtgcccccagcatcttggaggcccactgaggcctgggggggcgcggttt

SEQ ID NO: 685 - DNA, 4526 bp, Homo sapiens
tcttaacgcaattcacgggaacccactggcagcttctggaaaaccaaacaactcatggtgtggagctcctgattggggaagggacagggattggtctgtacctacattttgttgcaaaagagctcaggacactaacagagaggaaaactagggtggtctaggtggtaataaaatctctatgaaagaagagtatgattgtgtgactggggaatgggcaggtgctggactctggtgcagaggctgcctggcctgcgccaccccacggctggctagcagaccaagctacgttctttcattggctcctatgggacacagcatgggccaatgcctgcctggcctgcaggaaccgccagtgttgtttctagcaaggctccttggaatagatgtgaacacacaatgtaaaactgcatagcaggataaacacgtatggagtaggacaagctcacaacccaatgctgaccactactgacaagaccaagtatccaatcataacagatgagactttaacagttttgcataaatacatagtatttgtaaactattattaaggcactcaattgtaaaacaataattacagtgtaggaaaagagggaggaagcagctatcttctcatgcagcaaggccgacaggaaggacagtggaggactggtgatctgcttatcgggactcctgtctgagacagtgactgaagccggggccccagcacctatggccaaacaagaagacggcagtctctccagaaccacccagggcggcactggtcacagtttcattccagatcgttaaggccaggctattaagcatcaagtccagaatgcttcactctgctctgtggacgggaccagcgctctcgtctggatgttgatatgctagctgtgcttccaaaaatgaatgggtaagtttgccagaagccaaagaccaacttgtactctccagattccacaccccaccccccaactctttagataagaaaaattatggctttcaaaattaaagttttcaaaaatatatcattctcatacatagacgtggttaaaaaaccaacaaaagcctgtcatcactaaatttaaaagattattttgacacaaaaattgatctaccacatgaaatttgatttggcaaaacataccgaacttgatattttttgaggctatgcttttgttggctgagggaaagggggaacaacccacaggggtttaggaataagtggataatcaccttttaaggtgattttaattgacactagtgggaaaacagctccctataaagtaatgtatgtatttttaaaaatcactccaaggagacaaagtcctggagggaggatttttgcaaaaactgtgctcactaggtaaaatatgaactagccttgttcctgcagatccctcctggggtgctttctagaatagctttggggaacacagttctggccaatgttaagatgatggctcactcactcactttcagaattcagctggtccttgaaggctttctggtttcactgagttaatctggcggacccagctgagggcaagatggaattgtggaagagcttcagccaactgtgttcacctgccttcccccatgtacgcaacctactccatcctgcacaggtgaggctagtgcggggctggcaaagcttgtggtcgggaggagggaagggtctggccttaggtgtcagagaggcagagggcttcacatttacccagtttcttcctacagggccatgagcagccctgtgtggcaaatcaaaccaggggtcagcaactttttctacaaagggcctgacagtaagtacctcaggctttgtgggccacatgaattctgtcacatattatttcttttttttacaactccttaaaaaggtaaaagccatcgcttgagccagggaggttgatgctgcagtgagtcatgattgcactactgtactccagcctaggtgacagagccaggccctgtcttaaagaggaaaaaccattcctagctcacggggccacatgccatagtttgctgacccctgaattcaacctttctgcttttctgcaagctgcctctctctcgaaatgttttgacatctagcttgctgacacctttgattcaagcctggcgcagcgggactggctgagctcacctgagtcttaaaggggccgcccacagagccaggcagcgactacagatccctcttatactccctcactgctgctgggaagagctggagggaaacaggaagcagtaatctcactgcaggaaggggcaactgtagacatccgggaagcatcccgacagtcccgttcctttcggggaagccgctgaaatctcctttcccttccctagatgggccctagtggacctaagcatctgggctctcagcaggacgatgtgtctcagaaccaccacctgagccagacacttgagcaatttcaaacctaaacacaatcatgtgtttcagcagcagacactcaacaatgcaggtgggcccttccccttgagatttaaacttcagcattagcaacaactgagaacaacccatacattttccccaccggacccctgtgctggtcaaacacgtaacaacacaaccaggacagggcgcctgcaccaccattcgggcacagagtcagctcaacaacagcgtgggactactcatctgatgactttactcagcagtgcttggggctgtcgggttaaaagtcttgacacgtctggggtcccaaccaaaacacaaaacgaaaaattctttttttggaaaaacgctttcagacagagcattattccctggaacaagccttggtcattcgtgtgttttaaaaataaaaagcgcagcgagaacagaggtaggacttaatgttgccatccgagagttttctgcgaggccaagaatgagctagaacgtgtgccgcggtgaggctgccaccaccaggactcttctgcaggatgcgaagggaacagtctggatgtgtgcgcctatgtgtgcacgttcttcctaaaacatggttcttcttgaagacacggtgggagcggagttttgtgtctcctggccggcggctcctggttctcccaggccacacgactgacagctccccttcttgtgctgcatgttggttagtttcttctcctcctctctatggcaagagtaggggaaaagttaggatgacttcactcgtttaagggaaatcaagatgtaaggggtcgatccaaatccacagtgaaagtgagggagggatcatatgaaaatatccgcccagcctgacgcagcaaaaggcgggtcagcttttgctcatccacgaagggctctttaagttttctggggcgggtttccctgatggtttggaggttgcagctgggtccctcggggttccctggggctcatgcaagaaggaagattcactcaaagtggtgtcctgggagtcagcgacggtggacgggtcagcctcactggacaggtcttccgttgagaaggtgagactccccagcttggcaagagagtgtgagcgcttcagtggggaagagacggtgaggcccgccagccggagccgggtctcaatctcctgtgtccgctgcttcaccagcccgggcttcccacggacactgtggatgctatcgctgctggagctccgggtcaggttggagctcatggaagaggaggtgggggtgtagcagatggtcttcagaaagtcttttgagaaactactggtgtggtccaggcggtagaagaaaggaggggggctcttcagtgagcctccttccaatgaagcgggggcggcctctgacttctcatcactcccggcctggctgggcataaccagggggcccagctcgtggagcgcggctggatcctggctctcctcggggatgctggcctccagcctgctggcagggccatccctggagggaggtgctgggtctgcaggcacgctcttcagccgctctagctctttggtgtgcttgcggaccaagcctgccttctgcagctgaatgatggactcctggtgctgcatcaggtagctgttggttgtcggcttctcagattcattactgaacagaagcctcaggtccttggctggcttcatatctttcttgggtgacgattcttcctttattaccacttctgtgctgggagggttcttatcacagtgagaattcttcaaaaggagggactttggcaggacttttggggtctctctggaaggttccaaaaggctggctggtggctctagggcagctccagccccagggccactggtgtctgccctcctggagcctgctggtggtaggaacgggggaggttcggttgggccagaggctggcttctccggaacacgggacctgctggccaagtgggccacaggggaggacgtgatgtggggtaggaaggctggctgggtgcagatggcgggagcattggggtcctcacatcgctccctggaggcctcaggagccccgctggctgtagggtacatgcagtcggcacaggatttataggaaggcttcactttgttaaggatcccaaatatagcatcatcctgcaa

SEQ ID NO: 686 - DNA, 1649 bp, Homo sapiens
tgccgtctgtgggaagctgccctaacccattcgccttccccggcttggaaaaacaatgtcccagtgatgaactgccttgcagatttattttgatttaaatcgccttcccttcaacccaaaccagggcacagaaaggtggttagaatgttccagcacaaactcatatgagcacagcagctattccagggaaaagcgtcctccctacctgcaagaagcttcctttcaagacactgatattatcaagaacgtgaaggaagagtggcagcggcccacctgaggcacagcagagctgggggtgatgagagaaatttaagggaaatggcccctgttggacacgggcttcctttgactgtgtgggaatcccacctggccacagacaaagggtagaggaagcaagtgccccaggagtcttgatctcagcccagctcagcatgaggaaagcagcaagcaggaagagtgagtgttcctggtaccacggctaccaggctcttcccagtttagagtgctcaacattctaaaacttgaccagccagctgggagatttgggtattcagatttttgggtgccttaagattccactggcagtagagaatcactaaatgtccatttctgaatgaattctactccccagagacattaacacacgatgtacttggcttgaatcctgtttgatttaagaaaatcggccaagagtccttcataagttactcacatctgaggcaccatcgggctgaccgtgggacactccagatggggagtgctgtgtaccctctgcctctcctgtgacccgaacacctcctctctctctccatggacgacgttttcatcttatggtctgggaatgctacctgaccaccctggagggtcacccaaggaaagagttcgttccaaagacaggtgctcctctgagttcctctggaatctggcaaggtgccgagcttggacgcaaggcttccatgaggctgtgaaggaggttgcacggaaactggtggggatctgaaaagcttttagtggcctcgccacacacagcacttcagatgctcaggtgatgagcaacattttccaaacccagctagtgagcaccccacctcctctggcttccagaacctggtgtggagggccaggagaggcttcgggactgaagggcagagcagcagactccggggctcatgtaggaaggaacatgccttcagccaaagattatccacgctgcatggagactcttgctaaatatcactggtaaatgcacaattatgtcccatttagagatctctagcagagtgtcttgtgtttgatggatttgtcctgcatttaattataacttcctgctaaagctcagatgttttctttcaggggtaagactgaagaaaagaaataaactatgctacctgctcttaataaagatcattttattttaaacaggaggctgaataaaaccttttgactctgtatttcagacaaatgcagtggcttaatttcattcaatcatttactgaggatctgaaatgcatgcggttagtggtgagaatactgactcagggctgtcccttcctctggagttgacagccgactgcgcaggaagggaaggtgagggtcaaacacacaggtcaacatcagaaacagcacttccgccttccattggccccgat

SEQ ID NO: 687 - DNA, 7804 bp, Homo sapiens
aaagtggtactagccctgcgcaggtggggacgggtgctcggtttcctctagggagggaaggcgagagggggcggtggcagcgacaacaatgcagctaggtgccgtggcttcctgcgcgcggcggccgccaggtgcgtctccagactcccggcggcgtcgggcaggggatggttgctccgccgcaacggccgccagtgcgtacagtgaggcgccttgcagcgcagcgcggtgcaggctccacgggcccagacaccccgcgcgctgcacatccgggtcctggtgtgcagatggggcgtgggctcggcaaccagctggctgggggcgcccggcggagaaaagcgggacccctgctcccaaattccttggagatcgtacagccctcacctctttgcaggcgccccccccatcctgcctccccacccatgggaaaccttggatctgcaccagttgggacctcttctccaaagcgctccttggctttggagctaagtggcttcgtgcccgtagaagtggatttcaaacttcaataatcaagtattttagtgcaatttattttttatttttatttttgtagagacgaggatctcattatgttatccagggtggtctcgaatgtctgggcttaaatgatccttctgtctgggcctcccacagtgctgggattacaggcgcgagtcaccacacctggctagtccaacactttaaacataaaaaaatcagtgcaaaagagtccatgatggatgaaataccaaattgttatttatttatttattttcgagacggagttttactcttgttgcccaggctggagtgcaatggcgcgatctcagctcactgcaacctccatctcccgggttcaagggattctcctgcctcagcctcccaagtaggtgggattacaggcgactgccaccacgcccagctaattttttttttggccaggcttttctgcaacccctgacctcaagtgatctgcccgcttcaacctcccaaagtactaggattacaggcatgagccatcatgcccagccttttttttttttttttttgagagccttgctgtgttgcccaggctggagtgcaatggagcgatctccactcactgcaacctctgcctcctgggttcaagcgattcccctgcctcagcctcccgagtagctgggattacaggtatgcaccaccatacccagctaatttttttttttttagacggagtcttgctttgtcaccaggctggagtgcagtggcgccaggctggagtgcagtggcgcaatttcggctcagtgcatcctctgcctcccgggttcaagtgattctcctgcctcagcctcccgagtagctgggactacaggtgggcaccaccacgctcagctgatttttgtatttttagtagagatggagtttcactgtgttggtcaggttggtctatgaactcctgacctcaggtgatccaccggcctcggcctcgcaaagtgctgggatcatgggtgttagccaccgcacccggcctgaaataccaaaattttaagtaaagagccagacgtaggagtgtgcgcctgtggtcccagctacttaggaggctgaggcaggaggatcgcttgagcccaggagttggaggctgcagtgagctttgatcatgccactacactccagcctgggcgacaaaattataggaggcggttgttttagactaaactcttgtgctaggcaccaagacacaggaataaacaaaatgcagctagtcacactcagattctaagtcacaatgacgaagctaagttgttatctgacctttgggaaaaccaggagggagccctatcagcccattttctcttttattttattttctctctttctttctctctctctctctctctctctctccctttctttccaggaggagtctcacatttgtcgcctaggctggaatgcaatggcgcaatctcggctcactgcaacctctgccttccaggttcaagcgattctcctgcctcagcctcctgagtagctggaattacaggtgcccgccaccacacccggctaatttttttgtatttttagtagagacggggtttcgccatgttggccagactagtcgagaactactgaccttagatgatccggccaaccaattttccaaacaggccagtttcagccttcagtggccaatgtcctaaaattccctctgcttaatttctttaatccttacacaaaaaaactagcctggccgggtgtggtggctcacgcctgtaatcccagcactttgggaggccagggcgggtggatcacgaggtcaggagatcgagaccaccctggctaacacggtgaaaccccgtctctactaaaaatacaaaaaattagccgggcttggtggcgggcgcctctagtcccagctacttgggaggctgaggcaggagaatggcatgaacacggaagtcggagcttgcagtgagccgagatcgcgccactgcactccagcctaggcgacagagggagactccgtctcaaaaaaaaaaaaaaaaaaaaaaactagcctgaaacaacctgatggtaacactaatgagttaacacattctttgctgttgggtttttgttgttgttgttgctgttggttttgagataggtttctgtctcccaggttgttgtgcagtggctcagtcatggctcactacagcctcaaccgcccgggctcaggtgatcttcccacctcagcctcctgagtagctgggactacaggtgcacaccaccacgcctggctaattcttgtattttttgtcgagatggggttttgccaagttgcccaggctgctctcaaacttccgagttcggggatcctcccaaagtgctgggattacagacatgagccaccccgcccagcctgttctttgattttgctctctacaacccctctcttcctgtagagccaacctcctctgcccaactgattggaacagttatcctattttatggaatgaagtgtagcaaattgcaatgaagccggttaaggtccttagatttgttgaaatgttgtccattgacagcaaaaccccagctctgccattgcacgtatgagtcttaccttcattccggccctgctgattctgcgggggattgggtttttttgtttttgttttgttttgttttgttttagacagggtcttgctctgtcacccaggctggagtgtggtggtgccaatctcgactcaccgcaacctcggcctctcaggttcaactgattcttgtgcttcagcctcccgaatagctgggattacaggtgtgtgccaccatacctggctcatttttgtaattttatttaatttattaattttcttgagacagggtctctctctgtcactcaggctggagtgcagtggtgggatcttggctcacttcaacctccacctatcaggatcaagtgattctcctgcctcagcctcccgggcagtggggactacaggtgcacatcatcacaccggctaatttttggtatttttagtagagacgaggtttgaccgtgttggccaggctggtctcgaactcctgaccttaagggatctgccagcctcagcctcccaaagtgctgggattacaggtgtgagccaccacacctggccaggttttgtttttaagtataatttgtatttgttttggtgaagattcagattcacaagaagttgcaaaaatagtacagagagatttgtgcacctttctcccagctttccccagtgatagtatttttataactggctgggctccatggctcacacctgtaatccctgcactttgggaggccaaggcgggcgggtcaactgaggtcaggagtttgagaccagcctggccaacatggtgaaactcctgtctctactaaaaatacaaaaattagctgggcatggtggcgggagcctgtaagctcagctactcaggaggctgaggcaggagaatcgcttgaccccaggagacagaggttgcaatgagccgagattgtgccatcacactccagcccagacaacaagagcaacgctccatgtaaaacaaacaaacaaacaaaaagcttgaacccaggaggcggaggttgcagttaactgagattgcgccattgcactccagcctgggtgacagagcgagactccatctcaaaaaaaaaaaaaaaaaaaagattcaaaaaaagttttacatagccatgttatgttgtcaaaacctgggcgttgatgttagtataatggaatcaactcgagtgcagacattatttcgattgcacccgtttttacatgtaccttcctctgtgtgtgtttggttctattatttattattattattttttgagacagagtctctattgccgagtttggagtgcagtggcgcgatctcagctcactacaacctccgcttcccaggttcaagcaattctcgtgcctcagcctcctgagtagctgcgattacaggcgggcgccaccacactcagctaattttggtatttttagtagagacggggtgtcgccatgttgcccaggctggtcttgaactcctgaccttaaatgatccacctgcctcaatctcccaaaagtgctgagattacaggcatgagacagcgtgcttggcagttgagagaaattttgtctcacttgtagattcctgcaacccttgtggtttgaaggttctgtgtaatcatggtactgtgtctgtgttttaaaatatgttttgggctgggtgcctgcttcaagcctataatcccagccctttaggaggctgaggcaggaggattgcttaagcccaagagtttgagaccagccagggcaaaataacacgagatccccatctctacaaaaaaattattattatttttttgagatggagtctggctctgtcacccaggctgcagtgcaatggcgtgatctcggctcactgcaacctccgtctccttggttccagcaattcttctgcctcagcctcccaactaactgagactacagccgcgtgctaccacacccggctaatttttgtatttttagcagaaacggggtttcaccatgttggccaggctggtctccaactctggacctcaggtgatctgccttcctcggcctcccaaagtgctgggattacaggtgtgagccactgcgcccagctccccccccatttttttttttttttgagagagtcttgccctgttgcccaggctgggtggcacgatctcggctcactgcaagctccacttccagggttcacgccattctcctgcctcagccacctgagtagctgggactacaggcacctgccagcacgcctggctaattttttatatttttagtagagaaggggtttcactgtgttagccaggatggtcttgatctcctgacctcgtgatccgcccgcctcggcctcccaaagtgctgggattacaggcgtgagccaccgcgcctgaccccaaattttttcttaaattagctggccatggaggcacatacctttagtgccacctactccagagactgaggcaggaggatcactggagcccaggactttgaggctgcagtgagctatgatagcaccactgtactctggcctgagtgatagctagaccctgtctctaaaataattataataaatcaatgaagagtccttatcagttacaaataactgccaagcatatttacagaagaaatggtataggatttgcattgaaataacaggaagaggctggccactgtggctcacgcctgtaatcccagcactttgggagcccgagacgggcgaatcacctgaagtcaggagtttgagaccagcctgaccaacgtggagaaaccctgtctctactaaaaatacaaaattagctgggcgtagtggcacatgcctgtaatcccagctactcgggaggcagaggcaggagaatcgcttgaacccgggaggcagaggttgtggtgagccgagattgcactctagcctgggcaacaagagcgaaactctgtctcaaaaaaaaaaaaagaaaagaaataatggggagagtattgagggagaaaaataaaacaaaatggaatatatgtgttgccaattgttgaacctgaagggtggatcaggagggactcaggatgctctctacctaaaattgctgagccgtggcctggtgcagtggctcatacctgtaatcccagcactttgggaggctgaggcaggcggattgctagaggccaggagtttgagaccagcctggccaacatggtgaaaccccgtctctactaaaaatacaaaaattagctgggtgtgatggtgggcacctgtaatcccagctactcaggaggctgaggcgggagaattgcttgaaccctgaaggcagaggttatagtgagctgagatcgcaccactgcactccagcctgggcaacagagcaagactccatctcaacaacaacaaaaaaattgctgagccctgtcctagaaactgtcagaataaggtgtttccatgttagctgcgtctgtatcagcccccattctgtgatgatgaaagccagtatcagatgggaacacctgcccaggcattggctaagccactatcttttttttttttttttttttttttttttggattcagagtctcactccgtcacccaggctgggtgcaatcttggctgactgcaacctccgcctcctgggttcaagctgttctcctgcctcagcctcctgagtagctgggattagaggttcgtgccaacacacccagctaatttttgtatttctaatagagacggggttttgccatgttggccaggctggtctcgaactcttgacctcaagtgatctacctgccttggcctcccaaaatgttgagattataggcatgagccaccacatctggcctttttttgttttgttttgtttttttgtttgtttgtttgtagatttgggagggggagttttactctgctgcctaggctggtctcaaactcctggcctcaaaccatcttcctacattgacctcccaaactgctgagattacgggcttgagctgccatgcccagcctaaaccactgtcttaatctgcatccagctgtctccaaaggctaaaacacctccccttcttacatcagatatacaagtaatgaccaggcacagtagcttaacgctcataatctcagcactttgggaggccaaggcaggaggattgcttgagcccaggaggtcgaggctgcagtgagttgtgatagtggcactgcactccagccagggcaacagagcaagaccttgtctcaaaaataaaaaattaaaaagacatgcaaacaataatctttctgtattatcaagcacctactgtatacaaggcactgttttggttcagggatctgcaaacgttttctgtagagatccaggaaataactattttctgcttttggaccacatataatgtctagagcaattactcaactctgccatctaagggcaaaagaaaccgtagactataaataaacaaatcagcatggctggccgggagcggtggctcacgcctgtaatcccagcactttgagaggccgaggcaggcggaccatgaggtcaggagtttgagaccagcctggccaatatggtgaaaccccatctctactaaaaatacgaaaattagcagggcgtggtggtgcacacctatagtcccagctacttgggaggctgaggcaggagaatcgcctgaaccgggaggcggaggttgtggtgagccgagatcacaccactgcactccagcctggccgacagaacgaggctccgtctcaaaaaagaaaagaaaagaaaaaagaaaaacaaatgagcatggctgtgtgcta

SEQ ID NO: 688 - DNA, 1383 bp, Homo sapiens
gatatttgggttctgggtctggatcctggtagccaccacccaggtagcaaacccattgctgcaaggatgggtgatgtatgtctcactcaccttgtttctcatctccctggtgttcctgttgtcttccttgtttggatttgaatcctggagagttctgttcttcgccttcgtcaccatgctgctctacattctccatgccttcagcatctattaccactgatgcacaggcaccaggccaagggggaaatactctttgaaagccctgattatttctccccgaaagcagcttccaatgcttgccatctggatgataaacagaagatccactaaaacatccacaggattaacagagcttccttgcagactaagcgatgacaccacactttggacatttaaattcactctactgaataggaggaagcctttattttccttttcctgggaaagtaactgtctcttggaattatctgaccgtgaacttcctcttctagcaaactcacatgaaagccctcactgttgagaatcccagctccactgtcaagcctgtttggggattttgcctcagctgtgggcttccctagagtaggttcaggggaatactcagcctgattatcttaaaattgaagaagtgccaccaaggccttcagatctaatgcagatccacagaccttgctcctggtacttgttcagcctgtgctggggagccatggtcctgagttcccggggaggctggcagggtcaagccaccctgcccaccaccctcccacttcccctcccctttcctctccagcattgggatccaaggaaaatctgcatgaagccaattttgagggtagatttgtgtggaaaataaatcattatacagtaagacctggggcttgaggggtggggaatggggagggaagggcatagcctgctcctccatgagtctgacatctcagaaactgtgcagctgccggacgcctgggtcaggactccaagaccccacctcttaaggacaagaaaatgcctggttcctcagaaaagaccctcagggaagaaggtgaaaacattacatccaaggattctcctgccacaactggattggaagaaaaggctgccgcatcatctcagcgaggagtgaaggaaccatgtcccggggaccgcgctcctccacctgcactcaccccctcacattctcttaagcaccctgtggcccttcgaggcctggcagaatggtggtgcccaccgggttgggccagggctcaacgggcaaagttgtgcacactaaaatatcaaatcaaggtgcttggttttaaagtaaatgtttttctaaagaaagctgtgctcttctgctgacccagatgagtagggcacagccctgtaactgcacttgccttctgt

SEQ ID NO: 689 - DNA, 13997 bp, Homo sapiens
gagtcttctccagaacatctctcgattaaactcctcggtggtctcctgggcttcgccgacttgtgggtgtggcgtgtgggggccgaacggtggcgaatggaaaagctgaggtaagcggagccacctccctcgcccaagcccggctccccgccgccgccccagcccgccctctccgcgaccccgagcccggcctctccccgaccccgagcccggcctctccccgaccccgagcccgcccctgccgtcgcccgttctaactccgtcagctcaccccgcactcgaggcaggagcaaccgcagctcctccgccaagtgccggagctgctccaaaggcgaagccagggtggggactgcggctgcaggtgcagttgcgctcgccatctcagtcgcttgccgaaggccgcaaacacaggcctccgctgccactgccggagccgcactgcgacagccgctccacttccgggccacagcgtcaagggctcgtttccgtcaacaagccgtccagccccgtcccagaggccctgccctgcctcctcccgccacgaggcccggccccgcccgaggtccagcaccacccatcccgttatcagagaccaggcctggccccgcctcctcccgccccgccctgtcccctgaggtacagcaccaaccatcccactctcagaggccaggacaggccacgccttctcttgccccttaggccaggctacacaagcaagcctcaggctcaccgtctttcttattcatcattcattcatttatttgattagttgaaaacacttccgactaaggaagcagagagcccacaatcctgtgggaaaacaggcctgggaactaatatctcaggggtagtgagggtcgggcccagatcctcaaaggttccctgcccctgaaattgcacctttgacagctgctgaattccaagcacagcggtaagtgctttacatggggtaaccctaaaaaacacactgggcctcagacactcccgtacacacacccaacctctaccctgtggatgtcctagataagggttttctcttcacaaaggtaaatcaactctttgcctccttagggagggaaggaataaaggcattatttttgagacttttctgcagtccattctgcaggtatcagtagtgggtaatccctccaacgtccaggactccaaacgagcagctgctccctaaagctcacccaccaatcctggccctccacctgctactggggtagaggcctgggctacagacacagaggctgggcttctgcccagctgccagtggtgagacatggccttcaggagctcaggtggctttttaactgcaccatgaagattccaaacttggtggagttcagtgtccacacataacgaatgagaacaggtgtcagcagtgtcaaccaggtccgcaaaggggagaataaaaaagctagggtgccgtatgttgcataaagaaagtagcaggaataaacctgccagatgtacagcagtagcataagtaggtgaacaggcataattttcaagtattttctttgatggagatgagacctgaagttgtgaccaaagcaccgctgcagcaagctccaacacatgtaagccatcaaggggatgttaaaaaacgccagctggaaaagaacagaaccatagcttactcccaagtccttggaagagtttggtcttaataatgcattattagtggatcctaagactatgctgctatctgtcttggcgttagctaatttacttcaagcacagttgcttataacacaacagctgacttgtggctagttgtgtatttgcccatgtccttttattcatcttagaggcaggtatcatttaatttatgctgaagtcccaacttgtagtacagtatcatatacacagttaatacccaatggtgttaagctggaattgaactgagtaaatgtatacacacacatacaacaacccctcttttttggtggagtgaggggaggacttggctatcagtattttttttcttacctccatttttgtttgaggtagcatgataagtactggaatataaattagagtatctaaattataatccaagttgagctgctgtatgattcattcatttaacaaatatttattgagcacccattatgtagcaggcatgagctaggctccaagttggggacacaatggcaaacaagttagaaaaggtccgtcatagagcttacattctaacagggagaagacagacaaaaaaaaaaaccaaaaaatataattacagatcgtgattagttcaatgaaggaaagaactgggtcatgagaaggtaactgggagaaaggctctcagaggccagaaggacaagaatgaatcagcggagggaagtgcattctaggcagaaggaacaaatgaaaagcccagaggtgggagaggtcttggcctctttaaggaagtgcatgcagagcatgagccaggtggaaattggggcagtcggcaggacccagatcactgctctgcttcaaagcatttcaagctgaaaagtaagtgagctgattgtaaagtttttaaaagagcacactggatgctctgtattaagctgagagtaaggaggcaagaatatcagggagaagacccaggcaagaaataattacaacttagattaggaaaacagaaatggagagaagtggatggattcaagatatgcattggaagcagatcaaataaggtagagcttgctggtgaaatagatacagggtatgaaggaaagggaataattgaggatacatcttggagaaatcaggtgaatggtggagtcatttattaaaactggaaaaacagagaggaacaggtttggggtggaaataatgttcctatcagagagacatcacatgaagttgagatgcctgttagacatctgtggccattggatatagaggcacttgaagtgcagagaagaggtctagatcagagatatagatttgggattcatgggtctggatgatacataaaatccattattagtgtactatttattagaatatgaatgtaaacatttacaaaggaaaaaaccctgccttttggtaaggctcaggattcatttggtatgagagagctccttagagacagcctccatcaacataatagaaaactgcaatgaggctgggtgcagtggctcacgcctgtaatcccagcactttgggaggccgagacgggcggatcacctgaggtcaggagttcgagaccatcctggccaacacagtgaaaccctgtctctactaaaaatacaaaaattagccgggcatggtggcaggcacctgtaaccccagctacatgggaggctgaggcaggagaatcacttgaattagggaggcagaggttgcagtgagccgagacgatgccattgcactccagcctggacgacaagatcgagactccatctcaaaaaaaaaaaaaaaaagaaaagaaaagaaaagaaaactgaaatgaacccaggacctactcatgtatataatgctgctatgcagagaatattctggacttgggtcagtgtttgctaggcagaagtctttcctacttggctgtctctaatcctgttggatcatgttctactgccctgttagaaggccatgaacttattttgaatgtttttggatctcttccaaaacttcaaattttggtccactaactccattaggtgagtaaaataaagaaactgttagataaatacttttcaaatctgtttatgtagtttttctatggatcaaggttctttgtgtgtttattttaaaggaatcaaatgtaaacctaatacatcagtttgtttcctaaacaagtacattgctaggaaagcccaggtctggtttttgaataatgcagtttccactgaataactgacccatttttttaatgtgtctattttttagtttcctccctctaaaatattttccttcttcatcatcataatcagttttggtttactcagaaatctaaaactttttctaccataatcccttgtttcatttttttgtcaatgaaaaagcacagtgaaacaaaaacaacaaaaacttctttcacctcttataaacacttcatgacaaaaatgtattttaggctaggcatggtggctcacgcctataatcctagcactttcggaggccaaggcaggtgaatcatctgaggtcaggagttcgagaccagcctggccaacatggtgaaaccctgtctctactaaaagtgcaaaaattagccaggcatggtggcacatgcctgtaatcccagctacccaggaggctgaggcaggaaaatcgctggaacccaagaggtggaggctgcagtgagccaagattgcaccactgtgcttcagcctgggcgacagcagaacactgtcttggggaaaaaaaaatgtattttagatgtttacatgagagtggtggaaggagtttaggaagcactttaaaagcaaatgaagcttttattaaagactgccctgcaagtaaagtaggaaagatgatctatggtacttaattctggattttggatttaattcataactgttatgcaattagtctgacaagtccaagatgttcttaaattgcttttctgacttcttacctggagaattccaattataaatgttatgctgccttgtaggaaatgtccattaacaaatatcccaaaggaaaagcagcaaccaaatttgccatcaatgatttcaccaaaaaaccatggacctaaaagaggcaatggacaaaaaaggaggagattaaataactataattctgattacatatatcatgagatacatttataggaataaagcagagatatgagactagccatctataagcattttatttcatagccttccctctttgctagtctctgtgttgtacttgatatccttgctaaccaactattttttggattgtgaaattgtcttagtagacactatacctagaacagatatgtgtcttatagattctagaaacaaaaaaagcacactcacatttttgaaaattccattgcaataataacctcaatataatgcattaacatttcctttaagatgtaaagaggtattccacagaagttaaatttccagatgattgagatttactccttaaagcaaaaaaacttcaactactttttgaaagaaatctttctaagatgcactcgttaatataatgaatgtattttaacctcttcttgaaggcccacagtcattactttgtatatcaactacataatcacggttaccatgtagaaagtttaacttgcttcagttttctcatctggaatgccatgctgacttttctatcctccctattattatttactgccccattctcagtgtgtgagtttctaggtattattattattattattgtcattttgtcttgtaagtgtgctggtctccataagagtgtcaagttgtttgtcaagagtgataagggacagttagatttccgtttgcaaaatgcaaatactaggccaggcagggtggctcatgcctataatcccagcactttgggaggccaaggccggcagatcacctgaggtcaggagttcaagaccagcctggccaacatggtgaaatcctgtctgtactaaaaatacaaaaattagtcaggtgtggtggcacatgcctgtaatgccagctagtcgggaggctgaggtaggagaattgtttgaacccaggaggcagaggctgcagtgagccaagattgcaccactgtactccagcctgggcaacaaagcaagactacatctcaaaaaaaaaatgcaaataccatcatttgctggcaagaatagggttcagctttaaaaagtcagaggcaattttctcagatatactttatataaactgcattaaagacatatgagtctaaaaaggtgttttgtcttcagatttcaactttctgaatggaacaattcttccctattaatgtattttgttttgttttgttttacagcccaggaaccaaattacttgctttacctcattgtgtaagacaagcgtcaaaaacagcttcaacctatcttgaacaagagaacttacctccaaaggtgatctgccatagcttacacagaatcataaagtgttatattttcatttgttctctggtgggagttactaatgagcaaagtgcaaagggaggataaaagtgtaaaataaagactaagactaggcaacaaataggctaatgtactcctaattgacttttagtcactaagaaacataagcaaaaaagcctaaaagatttatggtgatttctgcttttataagtgtggctaagtgactttataagtacagtcatgcattgcttcaccatgaggatgcattctgagagatgtgtccttaggcaattttgtccttacatatcatacacaaacctacatgatatagtctattatatacctccagctccactagagtcttatgggaccaccactgtatatgtggtcccttgttgactgaaatgtttgtcatatgccacatgatactactgggtataataatacaacagaagagtgcagatatgcctgaactattgctcatctcagtttctctcttttttgagctgaatttttgagagccacacattagtaaatattcaatgaactacatactaagcaaaataggcaaaataccaatggatagatatatatactttttttttagatggcgtcttgctgtgttgcccaggctggatttgacctcctggactcaagcagtactctcgcctcagcccccaagtagctggaactacaggcatgagccaccgtacccgcctaccagtgaatattttaatgagttaatagataataaacacagaagataggtataaattctgataaaggtaatgatggaagtaaaacctgtgatgagatatagactaaaactttaagatagacaaagaaggttgctctgaggaggtgctatttaagcttctattaggtttctacacaaatactaattctgtagcagtcttctcagcacccttaagttaacttggtgttaactaaatgtcctttaaacatgttaggcacgagctttattttccaaaaccatgtcccagaaaatgatttatgaagaatccatgagccatttgttataccctcaagagtctaattctattgtcaaaattgttaatatattctttggcaaaattccccataatctgtactaatttacttacccagcactgtatacagggtcaacaacaacacagaatagtagaagatgtttattttgctcaagacatgaagagaaaatgaggtcagatttataaaccctgaaggttctaaaaaacataaagttgaaaaacccagtgaacacatgcaaagttcagtttctttatgacattttctagaagattttcatgggctatctaccatatattcagcaaatcctttgttagatggtaactatacagatgacaccactttaaattcagaatttggcaggaatcctggtgagacagttcacttagaattgcaaaaggcagagagttcgaagaaatggtgtagttgtgagatattttatatatatcataagatacataattgttatatatatcacaatatatcgaactcatatatatatgcacatatatgtacatatacatatatatataataactgaaagcaatggacacacctaccagagcaccatactattttatctttatataggtttgaaagatagtggtttgttcaaaggatgatcaagtctctgttttctatggaatttagtgtccaaatgtacaaacttcaaaaaggtatatcaaaatacttcaaaagtaaattaaaagaaatatcaaaatatcttcattctaatcataaatatgagtatctgtccaaatatggtcctttcctatacattatacagttctttttttttaatttttattattatactttaagttttagggtacatgtgcacaatgtgcaggttagttacatatgtatacatgtgccatgctggtgtgctgcacccattaactcgtcatttagcattaggtatatctcctaatgctatccctccccctgaccccaccccacaacagtccccagagtgtgatgttccccttcctgtgtccatgtgttctcattgttcaattcccaccgatgagtgagaacatacggtgtttggttttttgtccttgcgatagtttactgagaatgatgatttccaatttcatccatgtccctacaaaggacatgaactcattttttatggctgcatagtattccatggtgtatatgtgccacattttcttaatccagtctatcgttgttggacatttgggttggttccaagtctttgctattctgaatagtgccacaataaacatacatgtgcatgtgtctttatagcagcatgatttatagtcttttgggtatatacccagtaatgggatggctgggtcaaatggtatttctagttctagatccctgaagaatcaccacaccaacttccacaatggttgaactagtttacagtcccaccaacagtgtaaaagtgttcctatttctccacatcctctccagcacctgttgcttcctgactttttaatgattgccattctaactggtgtgagatggtatctcattgtggttttgatttccatttctctgatggccagtgacggtgagtattttttcatgtgttttttggctgcataagtgtcttcttttcacatagcagatttggtcttttcacatagtcccatatttcttggaggctttgctcgtttctttttattcttttttctctaaacttcccttctcgcttcatttcattcatttcatcttccatcgctgataccctttcttccagttgatcgcatcggctcctgaggcttctacattcttcacgtagttctcgagccttggctttcagctccatcagctcctttaagcacttctctgtattggttattctagttacacatttgtctaaatttttttcaaagtttttaacttctttgcctttggtttgaatttcctcctgtagctcggagtagtttgatcgtctgaagccttcttctctcaacttgtcaaagtcattctccgtccagctttgttccattgctggtgaggaactgtgttcctttggaggaggagaggcgctctgctttttagagttttccagtttttctgctctgtttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcatcagtggtggctgcagaacagcggattttcgtgaaccgcgaatgctgctgtctgatcgttcctctggaacttttgtctcagaggagtacccggccgtgtgagatgtcagtctgcccctactgggggtgcctcccagttgggctgctcgggggtcaggggtcagggacccacttgaggaggcagtctgcccattctcagatctccagctgcgtgctgggagaaccactgctctcttcaaagctgtcagacagggacatttaagtcttcagaggtgactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcactgctgccttgcagtttgatctcagaccgctgtgctagcaatcagcgagactccgtgggtgtaggaccctccaagccaggtgcgggatataatctgctggtgcgctgttttttaagcccatcagaaaagcgcagtattagggtgggagtgacccaattgtccaggtgccctctgttacccctttctttgactaggaaagggaactccccgaccccttgcgcttcccgagtgaggcaatgcctcgccctgcttcggctcacgcacggtgcgctggacccactgtcctgcgcccactgtctggcactccctagtgagatgaacctggtacctcagatggaaatgcagaaatcacccgtcttctgtgtcactcacgctgggaggtgtagaccggagctgttcctgttcggccatcttggctgccagcgctttccctatttctacagttcttaacgcacagctaacctcttactccaactgaaaggcttccctaaactttccaaattaacgtgcttttaaaatacagtgccaaaaagcccaagtgtaagggcttgactcagagaagctccattctgcggccacagtctacagtaccacagatcctcagccccaaccagccatgtcacccatgcatgtggctggccataaaccagtcagctgaggactatgaaaggaagttcagtatacactgagcaacactactggtaaaaaatatttaaaggactagtctcaatgaaagacagtctgatgtaagttaaataagtcatgtctttgctaaaagaccagcacattcattttatacttataaccttgctcagcctaacacttcattttatgcaaagcctgataatgcatgacctttcctactttgtgttactctctcagcttcttttttgttctagtctgtacttctcaaagtattagcctacatattcagatagaataataattatttattattttaaaaaatcctttagccttagaggcagctattctttaaattttaagtaattattctccattttggctgcacattagaataacctaggggaacttttagaaaatactcatgcttgtatctcaccctccagagattctgatttaatttgcctggggtagagggagatcttaggcagcaacccagtgattctaagcagtcaggattgagaaatactgctttagacaaagccgtgcttctcagtcttgactgcacattggaatcatccagggagctttaaaagatactgatgcttaggtcccaccctagagattctgatgtaattggtatagaatgctgttatagctattgaaatttcagaagttcccccagcagtttctaaggtacgaccaaagtggaaaagtcttgtttagaggaaagaactgacctggggtcagaagccttgggtttggagtctctcctctatctcttattagctatgaaaccttggacaatttacataacctcccaaaacctttgttttctaatctttaaaatggggtcaatagcacctacctcacatgattgttttaaggattaagtgaaacaatgtaggttaaaatatgtttcaaatttaaataactatataaaaatattgagagcccccatataagaggctggggacttcaaatatttatttacttacattatgttcaggaaaatacacatgtataataatgcttcttgaactttttcgtagaatttttaaaataaatataagaagaaaaacattcagtaggatgtgtactgtacctattcagttaatcatgttactgtttaatcattactacaatactccccttctctatcatcagtccttaatcccagggatttcatccaaattaagaagggatcaggaaaatttgattcaacaagtatttattgtctattatacacaaatttggtgctgggggctgtgggaaacagaagagaattaggaagcaagagttcctgcattgaagacaggcacagtggctcaagcctgtaatcccagcactttgcgagtctgaggtaggcggatccacctgaggtcaggagtttgagaccagcctggccaacatggtgaaacccatctctactaaaaaaaaaatacaaaaattacctgggtgtggtggtgcatgtctgtagtcccagctacttgggaggctgaggcaagagaattgcttgagaacccatgtggcagagattgcagtgagctgagatcataccactgcactccagcttggggttcacagcgagactgtctaaaaaaaaaaaaaaaaaaaaaaagttcctgcattgaggaacttatctggttaaggagaaaatgtatatacattcgaagtggttatataaagcaaagtggctgtctaattaagtatagaattaattgtgagaaaggactatagggattcagataagcaagagctcattatgacctggaatggctggagaaaacagtatgataaaggaggtcttcaggtaagccttacaggaggctaagatttagataagtttagaaaaataacttaaagtagggataatactatgagaaaaatacagaagcagaaatgagcatggcacgtatagggaacagtgaaaaagtatctaggctaaaatacaggtaactggttgaagacatggctagttaaataagactagactgtggaagatttttagtgtcttgcagagatgtctgacctttattcagtgtgttctggaaagccacttaaggcttttgcatacagaagtgatctatggatgagatgccataagaaggataattggctaataatgaagaggatgaattagatagagagactggatataagagcagcagttaggagtctattcaggaatccagagaggtgatactgacatggcattggtgacctctcaaaaggaaaaggaacatttgaagaaataattaatgggttgttttgtttttttgagatggagtctcactattttgcccaggctggagtgcagtggcgcagtcttggctcactgcaacctcagcctcctgagtagctgggattacaggtgcatgccaccacacccggctattttttgtatttttagtagagacaaggtttcaccatgttggccacggtgctctagaactcctgacctcaagtgatccatccaccttggcctcccaaagtactgggattacaggcatgagccactgcacctggcctgaattaatgagttttaatatgttgccattaggagtgaagactgatgcttactgaaaaatgactagatttttaaggtaaaaactgtagtaaggtcttcctgtaaggtctttatttttgatagtctatatgtttttatttttttaatatcagtatatgtatatatttttctatcaaaatatagtgatttcaaatgcctgaaagttcatgtgacttaagtaaatctttcataaaatacctgattttaaatttgttgataaaaacagaaatgtcttcagaattgtcagcatacattttttgcctgggtttactgatcagatagttttgcatttctctgtgctagatgttttaagcaggatttgaccaaaaggtcacaaaactatatatccagcctaaaatcagaatgatctttgtgtaactctttgataagtaaaactaatttaatatagttgatttaatgaagatagctgttttcagtttttggcaaaatatttatataattagctttaagatttctacttaggtgaacacccgaaattcacatgctgtaaaactgattaacagaaagataccttgacataatgactaactctatctaatatcttagttttcataagtaatctatgtgtagttaaaaaataagttagatgaatgtaaatgggataaatttataaatgaacttttcatgtgattttaaatcctaaagttacattatattaaattaagtaatagatactcatgaaatgtctgagtcatttctaagtaagataaaatactgaaacataaattgctaaacattagtataagttggttcttggtttcttaaattgcatagaaagacaaaacatacttgggtctattagtaaatagtaaactccacattcaaaaattgttccataaaaaattttttttagagattataaactatatattcatgagatgttaatatataacagttcaaaattacttacttccagagtaacctaaagcttaaggttactaaaaattaagtttttattaaggctgggcacagtggctcatgcctgtaatcccagcactttgggag

SEQ ID NO: 690 - DNA, 3242 bp, Homo sapiens
attagctgggtgtagtggtgcatgcctgtaatcccagctacttgggagtctgaggcaagagaatcacttgaacccaagaggtggaagttgcagtgagctgagatagcgccattgcactccagcatgggggacagagtgagatgccgtctcagaaagaaagaaaaagaaattcacaggaagagacagggaggcaggattatccagagctgtctatagcagagctgctgtgcacagagcctggtgctccagccctccgggctgggcggttgggaggagctcactgtaagcataccactctgaaatctctggtttagagcagcctagggcctttatgtcatccacgatgccataaaaaagttttctatgtatgccatgacatggaagaggtggggaaaacattggcatgaagtaacagcagaggactacatcagtgttaaggaaatctgaacacaatcctgtcagagttccagtgctgccgttctagaattttgttatcttataggtaatactttgaaaacaaataatccacatatctataaatccgtctggaagaggaacaaaaatgaatatacaaagatgtcattgttgtgaaaaaattaaaaaaatcttcaaagtagcaaaataaaataggtaaataagttatagtaaattcatgctatgaaatagtatacagctctttaaaatggaatttttctgaaaaggacacatactttaaagtgagaaaagcagggcacaaaatttgatacaagatacggattttgtaaaccgcactcagaaaataaaatcagatcattgcatgcaaaatagtgttcctgggtgatatgattataactattttttcaaaatagtttacttttttcaacttaaatataaaataaaacataaaaataaaaacgtgataatgtattcgatggcagttttaaaatgtaggattgcttgtatcccagaaatcttaagaaaatgtgtctaatcatttcatttctactttctatacctgtaacttacatggttgggaatacagtacggatgtccttttttaaaaaattaaaatatatacaacaccgtgaaggacttccttctagtgcagatgactgacaaaatgaagagaagatgcacctgttccagtggtgtctagtgatttgaacagaaagaaactgtgaagaaccaggaatgaaatcctgagatatgaaggggactgtctgaaatccatgtgcctttttgaggtagtttcgtatcatctcctggaagcagaaatgctacaaagcagtggaaggaagctggggttttccctgtcattggggagtttaactctggggagcttatttttccccaactttattaaggtatgatggataaatgaaaattgtatgtatttaaggtgtaccatgtgatgatttgatatgcatatacattgtgaaatgattacataatctgtctaattagcatatccatcccctcccataattaccttttttccgtggggaacacacttatgatttactctctcggtaaatgtcaagtatgcattattactaactataatcgttatgctgtacattagaacctgctcatcttatcctttaaccaacattgccccattaccacaacagattagagatttaaatctcttataatgcttatatttagacattttagaactctaaacttaaaaaaaaaacaattctgcttaataagagatttatccccagattatttgaagacaccaggaagagagaggtcagggaagggagtgtggcccagggtgaaggttcagcgaacacctgctagatgcatgcaggaatgaacatgccaacaagccttcccactgaatgcacccaagtagatgacatgagaatgcattctctgtctgcaacattcttggcttaacttgccactgactttagcaagcagccatgcattcctgtgatgcagctttaatggcctttcatttgctcacattggctgagccctgtgcagagtggatgccacctcccttcctgcagccctgccatcatgtccccaactgtcctcccccaaccctcctccactcctgtcacctcagttccaacaatatccttccttctctttttagcaggggatggtgagactaatttttccccaccccatctcgaaactaaggacttcagattgcatcttggtgttgcacttgaaacatcctaaagctaacctgtaagcttgtggcagctcctgggaggtggcatttcatagcttggtttatttgccaagttccctacactcttaggtatcaaagaatccagatgttcagtttctcctaatccctgttgataccctattttttttaaaataatagctagccctgattcctgtatgtctgaggattacagctattttttaaaatttaatttttaaagttctactagagatggggtctcactgcattgcccaggctgtcttgaactcccagccacaagtgatcgtttcaccttggcctcccaaagtgctgggattacaggcataagccaccatgcccagccccgattttgagttatcaattaataccagcattaaagtaggtgaagttctatgacagttcatttggcaactcaaagccctgctttccaagagcttattccagtgctttcattaaaagaggtaaactgaaacttttgagttcatgtcacccacattagcaatgtgtacgtgggtgcagccttcttcaatcgctatctttttagaatgagtcccttatttcctaggctaatgcttagtttctttgcaaaagtgcattcagactgaggtagcatccacttttaatgcttctgtgcattaaaagttgttgcgggaagtcagggaccccgaacggagggaccagctggagccacagcagagaaacataaattgtgaagatttcatggacgtttatcagttcccaaatactagttttataatttcttatgcctgcctttactttaatctcttaatcctgttatcttcataagctgaggatatacatcacctcaggaccactgtgataattgtgttaactgtataaattgattgtaaaacgtgtgtttgaacaatatgaaatcagtgcaccttgaaaaagaacagagtaacagcgatttttagggaacaagggaagataaccataaggtctgactgcctgtggggtcaggcaaaaaaagccctatttttcttcttgcagagagcctataaatggacgtgcaagtagggaagatatcgctaaattctttttctag

SEQ ID NO: 691 - DNA, 12044 bp, Homo sapiens
gagcttcactggaggtgggtaagttttgtttcagacctgtagggctgaaagtgttgacgaacacctgggagaaaatgtccagtcaccgtcactgcaaatgcgggtccgaccttcaggagagggatttggactgaagatgtgggtaggagcaccctctcttagacaagaaaaattgagactaagaggagatgagatcgctgggggatcataattaagtaaaaacttgtatctctaaaatccgtcctgacattttcatttataggatatacatatgtatgtatctgttataatctgaaatgtgtccctcaaaattcatatttgaagccctaacctcctcatacctcagactgggactgtatttggagatgaggcctttaaaaagataattaaggtaaaacgaaggcattagaatgggctctaatccaatatgtcaggagtccttataggaagaggagatgaggacacagacacccacagagggaagacggtgtgaggacacagggagaggacaccatctgcaagcccaggagggaggcctcaggagaaaccaatcccgcccacacctggatgtggggcttccagcccccagcactgcgagggaataaagctccgttgtgtaagctgccgcatctgtggtattttattatggcagccccagctactaatacagtacccctaccgatacatacatatttacccacatgtagccacacacatgtgcacatatgtaatctttttgcctataaaaaagtaagcaatgcctaaaagtacaggtggagagaaggctaaaaagcacaggctcgaagagactgccaagatacaacgatccaacaaagacacatcgtatcaacagtaatgatttcctaaatgtgaaggtaatttggatggctggtttatagttttcatgcccgggagttttccaaggcacaatgtataccctttgcggcagcttactctcctgaaatgtgccttcatgaaattagataaacagggagaagatatgaagtacatctgcctaacaccacgttagaagaatccccgggcatttgcatcttatgcgatgatatgctggcaaaccttggccaacttccagtcttgtccttatgacaggggactgctgtgttgagttcccgtctcaggcctcacatccaccttggccctgccttgggagcctgtaggtgtgggcagaaaagagggacgctgccttcctggctgggcctttcttcacacacaggcacgaggacccaagctctaaaggatgaagtccccatggtctccgaagttttcattatcatccccctcctaaagctccaccttggaggcaatgcactgtaacaaaaggaccagcacagtgcccagcacacagaaagctatcaatcaatgtcagccttaaccattatgttggttgacttgccatccctcttcctcaactgcaaactatgtgagagaaagattcatgtaaccttggtattacacaactccatcgtggtgggttcagttgcatttgtcaaatgattcagagtaggacaacgggaattttctttacaacatcacagcattgtaaagtctttgctttgcacgaaagtgtgggactgaagaaatgattgtgcaggttgaaactgtgaagcaattttaagaagcaacaaggaaaattatgattgtttcataatcttcaaaaaatttttaaagtgttaagaactgttttactactggtcgtaaatgtataagaacatttaaagatagcaaattgaatacttatttagcctgtcataatttaaaaaatgagaaacattgagaaatagtgttttatttctttgtaaaagacttatggagagtaaattgaaaagggctttgccaccttctcattgtgaaacttacagtatggaccaggcatcttttctatgccttggcaaattgtcacattcctttctatatttggataggcttcctacattttgtcctgcacactttcagtgctgtgaaatatctccaagagtttctttaatatgaagtttttgccagcatctttatcctgagtccctcaaaagacacatccagaatctctcaaaagacaacagcatcaactttcccaccatcagctctttcttctctaaactcgtttacgtctgagtcaactttcacctcctgcattctcactttttgtttctttgctatactttcctcttcattggctacctacctctcttgagtattcatttctgtgaaatgtcacgtgggtttgtcactgggagccaagagagcagcacgaccacacgctttgctgtctgtgtgggaactgataacacggaaggactgaaggacgtgatgcggttaatcactgatcatgatgcacatctgttattacgtggtggtctgtggactgcagagcaagcagcagaggttgtcccccatgcaatcactcacagttaatggtgactgaaattggaaccatgttgttagggggctggtgttatttaacctcagttgccacagggcaatgaaaattcgtgcgtttgggaactatgcaaggtgaggactgcctgaatgttccataatgtgatgagtgcctcacaaacagggtgtatattatcactgagttttttcattattcttgaccttcaatatatagacattcttgttgatggtatcaggttgtttctgcgtgaatgagctttactcctctgagaaatggcattcctgaccctcctctttgaatcaattgcacaaaagtatctgaaggaaatttgcttacctgctgctttctatggaagctttcctgcagcatgacctagtgtctgtttctggttgatgattaaccatggggaacaagcgtttgagataaagaagttgcagaactttttagagaatgtaatatgttaatgtgcactgggactctccctgagctatatcaagtttcctggattctgaaatgctataattttaaaagtgtcataaggttaaaacagctttctaagaagtgcctttgttggaagaatacccaggaatggtgcgctggacagcttttgtacaagtcttgcattttctcagaactatctctcatcttggccatggcatcagtcacatcctgagtggctcaccttgacttgggttgcctcctactgcagttctcctaaactctggtgggggacacgggcacaacccacccaatactcgtatgtgctttacctggaaataaggagcagaggagctaggggaaggagccgatggctaaatgttcctgccttttttccctcaggcagacagttctaaggtgcacgctgtaggttgctgggacaaccctggcaagatcttcccccagacatccaccttggcggccgacttattaactcattggtctattgacttttgctccttgcctcgcccctgatccctgtgccctctttctaataagctacctgctggtgaggctctgccttgggggaaacccaggctgaggcaggtgggatgttataaccagggaggcctgagtcctgggtctttgcctggggtccccaaataggagagggattggaggaggtattgtgggggagagtgttgcaaaagcccagaggaaaggagtgctgttaccacaacagaggagacatgaacctgcacagaccaaaaacaggagagagagagggaaagagaaagagaagggggagaaagaaagggagagacagaggaagggagagatggggaaagaggagaggagaaagggagggagagaaagaaaggagatggagagagaaaagggtggggagagagataaagagagaggtaaagagagagagagaatcatctactacatgatttcttttttttttttttctgagatggagtttcgctcttgttgcccaggctggagtgcagtggcgtgatctcggctcactgcaacctccatctcccgggttcaagcgattctcctacctcagcttcctgagtagctgggattacaggtgcctgccaccacgcccagctaatttttgtatttttggtagagacggggtttcaccgtgttgaccaggctggtctcgaactcctgacctcaggtgatccgcccgcctcggcctcccaaagtgctgggattacaggtgtgagccaccgcgcctggccatgattttttttttaacctataaaagccttgagtagtgatggacgcgattcctagtaatgtggtttactaaagggtcaggctgtcagttcaccacaaatacgccacagtagtgtttggtattctctcaatgttccacccaccagagcatacaaaacagccacattccccaaacacttaattctcaaaacatacttgtagaggagggaagcctattactcccattagaaagatggaaaaccaaggtgaaatgattaactgagctaccagggcctcagaagaaagtcgctgctgagtttgggattgtgttttcaacttcctgcccactgtgggtgagctccaccttttactggaaccaactccaaggaggaagttttgctgggtttcctggaaggcagaggtttgcatctgcatgccctgcgtggaggcattgtatttgggggcaggcaggagaatactgtagctggtgtgcccacagaaagggagggagagaagccactgggagtgagctgggcttgggatcgggctgtgtcctcaccaactgtctgcccaggcatgaacttgccactgctgtggaagagtctgactgcatccaagaatgccaaaggttgtggctgaactcacttctcaacagacttggatcatgttcatatactattctttaaaagatcaccatttgtagtagaatgtcaaaaacccaaagatgttgctcccgatgttgagctgtaactattttctgtgttggtggaaaaatatgagagaattagttgccattcatgaatctcagtgatacacagacaaaagcatgcttcaattttgtttctttgtttttgagtggttctgatttattttcagcttttgggtgatgtctggggctgtttattgaggacgggataaatgggggggggaccaaaatatatttggcatttattggtggtgttttatatttgtgacttgatttacttcttatcacaacccagtgagacacgtactattatcatccttttaatagatgagcagcctggagcttagagaggttaggtagcatggacatcatcaggcaagttaaatgagaaagccgccacccattcccagctggggctgaccccagcgcctgtgttatttctgttgccctgagcctccccaggcttcttaacccacatgtactcctagcttccagcagtgctaatttacaccgtgtaccagctggagacattctggagtgtagactgacgcaataatccccaatgataggtttgccatgttttttttaaatgtgttttttcctactttttattatagatgtcagaattttctccttccctgagttatctttggacttagatgtatataaatgtatctggttggaggtggggggaaaagtggaagtggaagaccacaaaagtaaaaattacatttgagtgtatttcaccgattctaagaggaatgctttcttctgctccaaccactctgaaatctccgggtcccatactcccatcgcagctgtgtgacatggttgccgtggcctttgtgtgaacatcaaagctcagaggatgggtgtcagaggcttagatgaaaatcctgaagacaattgtctggcacttttcaaagctatacggcctcaccaaaaccctcctggaagctcttgatggctcgaggttcaacagtgtctgggaagacatggatataaaagatccagaatcaaagagtgattccaaagagttagaggctgactgtgaagtcttaggcatactgtaacccagtgatttacctatctttgcttttctgctcatgcagaagagtgatatatgatgaataaattctaagttcaattaggcctaaaagagctcttgtaatatgctttaaaaagtctaagtgataaaacattgtgacagatagagttctgtcagtgtttatattttcttagtccttcattaaataacagtgtgtcttacaccaaggcagttttggattccataaaatatggtagtagttatgtttcatgtttcaatagtcatcaatctgtttttaatgtattcatggaaaaatatgtgggccatcttgctatttaactatttttgaaatctcatggaagcctgccaatgtttttgcaatttagctaagaagctgtcttgctttttgagaggggaagttccaatattgtaagcctaggtttctgaatatatttttgttttttaataaatgtagaaagaatgttttttgttaatcctggcatttgtctagagcaaaagcaaaataaatgaaaagtgaggaaaattaaaaggctcacgttataacatgtgctgtctagagaataaaaactcatttgtgcaaagttggtatggcttttatgaaaatatttcagtccgagcaccttgcctgtttgctgcagtgctgactgactcatgattagggatctgtgttgcctttattgctctcggtttgccctatggcttgatttattaatatatttaaatatacaattttaaccttatcattggtgtgcaggtgtatttatttatactatctttgcttttagaaaaacactattatatcataaaaatattttaaccttaaattacttcccacaggcttcaagttttatgcagttcatatctgggcataaagagaaatcaatatactgtggcctgcagggcaccagcctttggtgtttgtcaaacgtttacagataactaatgtcccacataaaatagatccattctttccatcttgcacatcttgcacctttcttttttttttttttgtatgaccactgccgtgtagccatcatgtctggactgatagtagtttctaggcttggaggaaactgcattttcaagaaagcaggatgcagacatcccctgaggaacacctgcattaaacatagcctcccacctaaaaagagctccctgagttgggaagtgtcttattggcctctccttccggcctctcccactccctatgctgaaaccaagagcttcggggctcccctccctgcccaccctggcagggagcccagggccctcgttgctctccctgtctcctatgctgtccgagaacccctgcagctccaggccctggaccagccacagagtttacttctactgttgcaatactttgaagggagaagagtttcagcctttttgatcagtggggcttctacttaaaatccttccatggcaccccattatctcagggtaacgtccagactcctaaagtggcttccaaagtccttcattatctgatgggcctctgtgtactttctctctcttctctctccattcctggccctcctcatcaattctctggccattttgaacttgactcagtctccccaatgtgccaggctttccctggcttcccggctctgcgggaggatgagagtgggctcaactgtcttttgagggaatcctggaaacacacccaccctgagagtcattgttttgatggaagtgacattccaaaccaacatttggaaccaagtcctgtaagccagaacctgcacaggttttgttaaaggaatcaatttaggcctggcactgaactcctttctgctgtaagactcttttagaactttggaagtttctatgcaggggactgagccatcctgtccctgcctggttgggcatgagaagtcacttggaataggtctgagtgaatgctgatgaactccgacttagctctggtaaacagtgcaagttcccatgagactgcagggcaagaacagggcaggctgcacaccgcggggagaggcacacctcgttccgtcaagagacacctgggcctggtgcaggcgcattctccgtggttaacgggtgtgaaatcggcatttatcatcagtgacttttcattgtgtggcttctgtgagtccccaccttccttctaaacctcagcaggacactttcccttccctgtagttcaaatatgcgccgcaacctcagcttgatctcaagctttctattgccatgtaaacaatcagggagccctggaatggtgggctccaggggtgggtgggtcagggccacccccaggggtgcagagtctgaaggggctaaactccgggcggaggctggggggcctcaaaagcattttcatgcaggtgagaaaaggaaaatttccagggcatcttggctgaagcacagaagtgactcccggaagacctggcatgtgtgagatgtaggagggatgctctgtgcctgcttgtgtgtgtgcatgagtgcgtgtgtgtgtatgtgtgtatgcgtgtacatgtggtgggtatgatgagcctcggggctccctttagcatctgctggtgagtttactgtgcctgccgaccgtttcccaggtcaggcctccgcccatgataactactgtttaccaaacacttactgtaggtcagtgactcacatatgtgatctcatttcactctcccaacaaccctgacgtaaggactattatccctatttaacacatgaggaaagggaggtttgagagctctggttactttttcacattctgaagctaggtgcctccacagcacatgaaatgttctgccgtcgttcgtctccctgggaccatatggaaacgggggctgcttcccctggagatcacaaagggcttctgcagtagagaaaggagactaagagcacctttctagacttttccttagcattcttcaagatgtactatcagaagttcaataaaaacaacctaatgctgagattcatggatagaaaattgactcaacttcctgccttccgacgagcttattttcttcttagccattgtaaattggtggagccgtgttcctccttgtcttagaaacttttaatggtgctgttgccctcaggttaaggtctggactccttgtggctctccaaatccctcagagtccttcattgtctgagcaggcacactcatcttctgtagtttaaaaggtggcagtggctgggcgcagtggctcacgcctgtaatcccagcactttgggaggccgaggcaggcagatcacctgaagttgggagtttgagaccagcctgaccaacatggagaaaccccgtctctactaaaaatacaaaattagccaggcgtggtggcacatgcctgtaaccccagctacccgggaggctgaggcaggagaatcgcttgaacctgggaggcagaagttggggtgagctgatatcgctccattgcactccagtctgggcaacaagagcaaaactcactctcaaaaaaaaaaaaaagagtgacagtaatgacatgatcattaaacatctttcagggaagactctatgagaccgatgtttgcatgctaaagacaggtgttgctgccggaaagtgattcggtttgaggactcaggacttgggaacatcagtctcatctcaacagaacccttttttcagttccctgctgtttcctgcacaaactgggggaatgtgcttggcctccctggagctcggattgtctagcagcttggattgcttagtccccctttccacaccttcctgccaccctgagggggaggcctgatggttcatgggcttccgcagaaggaatttgcccactctgcttcctaaaatgtgcagctgcattttgctgctgggaaaatattgattgaaggtctggaggagtctgacaacttgtaaggcacatacagtttttatctgcaggatgaagttagtttttgtttgggcctggtgttttcgaaagaaggaaatcactttcataagcatcagattagatccaggaagcgtccgcaggacaatgagaagctgatagaggcagtgtctcaggattttgccattggttactaccgccacctcctggctgaaattgtgaactacacagcatgggcttcctgggcaaactggtttaagaaaaggtagccccgttttccccattttctgcaagttctgtgtggcgcaaaaaggaaatgagaagacttattgtttagatagagtatttattggcatattttatattaactgtgatgataaagcagacacaagaataagaaataaaatcagagtgaatttttctcatctgaggcaacagggaaaataattcattggaacaaccctgtgactcagtgttagctttgcccaaaataagtgtcaaggcccttatctgagtttccaagaccccctgcccattctcttaagctgacctcttagcatattgagggaaatctaccaaacattttggaaaattagtacaaaattaaggaattaaaatgaaaattgcaatataaaaaattattgggtctgaggcatgtcttcaggttgtacaaggaaaagatgtaagatttggtatctctcctcttcattattttatattggttttatacataagccctcaccctgtagaaatataagttctaagttaggaaaaggattatttgtaacatacatgcaatacacatacattgacagaaatagaaacaggctttttctgttatttaaatagtatttttggagtagattggtttttcgtttgtttgtttttgagacagagtcttgccctgtcgccaggctggagtgcagtggcgcgatctctgctccttgcaatattttcctcccgggttcaagtgattctcctgcctctgcctcccgaatagctgggactacaagcgtgtgccaccatacccagctaatttttgtatttttactagagacagggtttcaccatgttggtcaggatggtctctatctcctgacctcatgatccgcctgcctcggcctcccaaagtgctgggattacaggagtgagccactgtgcctggcggattgtatttttaaaaatttatttagagatggggtcttgctctgtcaagcaggttggatggagtgcagtggcgcgatcataactcactgcagccttgacttcctaagtcaagcaaccctcctccctcagcctttccagaggacagcagctggggccttcagacaattacgtttccttagtcggacatctgagaggcataatttcatggctaccacagaaactgagagcaaatattacatttctcatccccccttgaagcttgggtcttgctgaatattgttttcataaagcaatctgccatattgaaaaagccatgtaatgagaaactgtgtgcaacctccagccaacagctaggaaagaactgaggccctcagtcttctcaggtggcctactggccaatatgtacaagttgtatatacaacttccagaagggtccttaaaagaagagggctatcactttcttgccttcttttctttcttgctggctggaatgtgatgatatcactagatctgaaacagccattttggactaaaaggcagaagccacaggtgaggatgatggagttacaaaataaaagaagtccaagtcctagtgaactgggccaccatgaacttcccaggtttactggagagagaaataaacctctaacttgtgtatgtctctgcttgattttcagttacttataacagaactttatccaaactgaaaaaaattttacattttatatgtaaagtccgaagtttaacagagttagtatttcccagacgataaatcatgggaaaaataaaagtttaattacctaggactattactgggagatgatatttgctgcatatagtgaaggtgctagcaaatctcccctttttgttgctaagagggtgttccacttagttagccagggcaacagaaggaaaccattgatgttcctcacggagaagtctttgaaaacagcacatgagacagcagctaagagcgccccccaccgcattccaggctaatagcattggctccagaggctaacagggtttattgagtgaagggaccaagggggaaaccagcttgattttaattgtctgtctagtctgttggaaactaactttctctaaatgaatgctttttgaagttttcaaagctcgagaacataataaatattaccctttgctgggtt

SEQ ID NO: 692 - DNA, 2023 bp, Homo sapiens
gggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcaggtgagaacgtccgcggtagaggtgacacccagggcctgcgggtctcagaggcccggtggcctgctcctctcctccttgcccaagaaacccccacgggggcgcctgcagcggggacaccaagtgctccccggagccctgggagcacttcttctgaggcatggagcccctgctcaggtgcttctgaaagttcctttgtggaccccagaaacccctaggcaactgtctgccccgccccgcgcccccgccgccccccgcccccgcagtacccctccggcccccgacatccctgatgcgcatgcccaggggccctgtgagctagaaagtagctgagctggtgcagtacctgctggttaagaaccggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgcatactgcaaagttttgtttgccttaattaactttcttttataatgatgatcattttacaggaaataaactggttaaaactacatgatgacagaattatatcagagttgaaacaaacgccatacctaagcatttttttcaaaatcctttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattaga

SEQ ID NO: 693 - DNA, 1420 bp, Homo sapiens
gtactgagtttaaaaataagctggggttatttatatctaatatgattttcacttaacaagaattactaaggtgctagaaaaaatatatgtatatataatatagtttatgaaatcttagttataaaatagcccttttttcctcctaaaaaattatattctcttcaacttggatgcaagactctattgtctatgcctttgaatactgcaattttagagtgttgattttgacattttattttaagggataagtgagcaatttttgttatcattaaaacttaaagaacttggatcttgtcacaaaaacatcaaataataggtaatttaagagtaaaatacaagagatttttgagagattgagagagccttagaatgtgaaagaaatgttaaaatagagttttcacttggtcatagtttcaaagaaataaaatcagttcttaggacttaatgattttctaatataggaagtcaaaagtatgtaaaattttatgaggaaacaagctaatatctacttcagttttcatttaaaaatatttttaaatagagacgtgatctcaccaacttcaattttcataaagtacaattttcataaatctttttcaaatagccagtggacatttttaaagcattaatgggaaaatgtctagctcttttatttatttatagttacattggtaaagcttttatcaagaagtaatactgagtttaccattttgaatagactctgtatttgcttttgaaagaagtagtgagagaattgtagatattgaataacaaactccagctgcctaactgaaaaactaaattccttatagactatcgtaaagaatccacaaaaaacctattagaggtaataaatgaatttggcagttgcaggtactagatcaacaggcaaaaaccagttgcatttttatactgtagcaacaagtggcctgaaaaatgcagttaagagatcaatttcatttacaatagcatcaaaagtcataaaacacttaagaataaatttagccaaggagctgcaagatttgtatgctgaaaactgtaaaacattgctgaaagaaatcaaagtaaacctacacacattgaaagatattccaggttcatagaatggaatactaaatactgttaagatgtaggtatcacccaaagcaatatgtagattcagtgcaatccctatcaaaatgtcagtggtctttgttgtaaagagggaaaaggttatcctaaaattaatatggaattacaagaggctctgaatagccaaaacagtctgaaaaagaacaaagttgtaagactcagactttccaattttaaaaataaattggactacatcaaaaacaaaaactttcgtacatcaaataacatatcaagaatgtgaaaaaagggctggacgcagtggctgatgcctgtaatctcagcactttgg

SEQ ID NO: 694 - DNA, 6026 bp, Homo sapiens
tagatgatcggaaagaacaaatggtgcatgtgtgcgcgaacgagccccagtttctctccatccaggtccccagcggactcagagcggccgccgcactccacggcctgggaggacagaggccccgcagcctcccaacctcggctcatgtggggggcgcgccgcgcagggtgggcgagtccccaggccccagagtctgccggagccagggtgcgcggtgcggcggctgacaaagagcctgggaacttggagcttgtgagttttatggtcccagctcactccaacaccgaagccctctgaggctgttcagggccggggttcccaggcctaccaggagtttccctctgatgcctgctaggggctttccgtgagcaggcctggccatgcccacacatgatgaggagacccgacttttcacccagaggttgcaacctggcagctcacaggttggattcattctgcaaatgtgttttgttggatccacatagtgtttccaaacattctgaatcattattttaaaaatcaggaatatttaaagtctggatctctagcttctgtttcaaaagtcagaccatctggcaatactgtacctgcattccacatgacaattggtgacgggaagccctgtgaacctggggaggctatgaacacatctgcggatgatcctcaatcagaaagcagaccatgagaaagggcagcacacggatgcctgctcctgctctgctcacctgtgcctctttgtgcagctggatctgccagcctatttgaatctaatccccgttcaatatttgcatttttgtgaatacccctccctttgattctttgcaaaggggcttgaacttgattgactgagaccgtggagcaatgtatgcaccaggacactatcacaaacaatagagcaaccaacaggcaattagtagagtctaatagctggatgagatatcaagagacatagagatagacagcttacagacagatcaggtaaacaaacagtgaaagagaatcctgctaaaaccactgttatcccatgatgactatgtacgtgctcaaggctgtgctttctaaggagcaacatcagtgcctttacactgcaggaaaagtggacttcacccagatgggccagtcaaattactaaacagataaacaacaaagaacaacaatctccagagacaggggcttcagggaaaatcagtattctgagtggctatagtatattatctaaaatgtcaaattttcgacaaaaaatcatgaggcacacaaataaacatgacagggaaactcatacatgggaggtaaaagcagataacacaaactgtcagagggcccaaacacaagacttaacaaagataatcatcacaaatatatccaaaaaactgaaggcaaccatgcttaaggaagtaagagaagagatgatgatgctgtctcattaaatagagaatatcaataaagagacagaaatgattaaaaagattcgaatggaaattctggagttgaaaagtataataaccaaagtagaaaattcactagaggagttcaacagaaggtttgaactgccagaaaaaaagaatcagcaaacatgaagatatattaatagagactgtgaaataaaaaacagagagataaaaaatgaagaaaaatgaacaaaacctcaaagaaatgtgggacaccataaagtgtacagatatacatgatgattatataagaagaagagggagaggaaagagcagaaaaaatatttgaataagtaatggctgaaatgtatcacatttgataaaaaattaatatacatatccaagaaccccaacaaactccaagtaggattaatgcaaacaaatccatgcccagacacatcatattaaaaatgttaaccctccaaaacattaacagttgacttctcatcagaaatagtgccatccagaaggcaatgggattccatattcaaagtgctaaaagaaaaaatccaaccaagaatcttatatccagaaaatcaatccttcaaaaaagagggtataataaaaatattcccagataaacaaaaactaagagattttattgctggaagacctatctcacaagaatactcaagggaaaaattttcaggttgacaagtgaccccagatggaattttgagtttacataaaaaacaaagggcatcagtaaaggtaagcatgtaattataaaagacgtggatgtaattataaaataaatggatatttattctttcttctcttaacctatttgaaaagcagtggtataaaacaatatgtatttaattgtattgttgagccaaaacatatagaaatgtaatatatttgacaagaacagtatcaaggatgtgaatgtgaacaaagctgtatttgtgtaagacaataacaccagatggcaactggaatgtacaggaacaaatgaagagggctataaatggtaaataataaggttaatgtaacaaacttcataattataaacttgttctcctttcttctcttctttaaaagacataaaattatgtaatgcaataagtataactgtaccattgggtttgttatatatatatatgtatatgtgctattattgttatatatatatatataatagcataaaaaaggatggaaaggtatagagctatgtagaagcaacacttctatatcttattgaaattaagttactataaatctgaagttgattctaagttaaggtgtatatgataaaccatgtaaaagccactaagaaaataactcagaaatacagtgaaaaattattaaagcaattaaaatattacacaagaaaatatttacttaatgcaaaagaagcagtaaaggagaaatagatgaacaaaaaagacatgagatatgtgatatgtagaaaacaaagagcaaaatgacagacataagtccaactttatttatttatttgtttttttaattatactttaagttctagggtacatgtgcaccacgtgcaggtttgttacatatgtatacatgcgccatgttggtgtgctgcacccatttgtccaactttaaaaaataacattaaatgtaaatggattaaacaatccaacaaaaaggttgatattttcagactgaataaaaaaataagacctaactataagctgtgtgtaggagacacactttagaactaacaatacaaataagtaaaaagtaaaaagatgaaaaaacatttatcatgcgaacagtaaccataagaaagaagtggcagctctgctgatatcagacactgtaaaacaaaaaatgttactaaaggcaaatacaaacatttaaattgatcaaatttatcagaaaaatgtaataattataaacacatatgtacctaataatagagcctcctaaaaacatgaagcaaaaacagaaatgaaaggaaaaatagacaattcaacaataatagttggagacttcaatatcccactttcagtaatggctagaacaacaaagcagaaggaagtagaagaagcaaggaagtagaagacttgagcaacaccataaatcaactaggtctttgaaatacacatttcacccaagagcaagatacacgttcttctcgaatgcacatggaacatttgccataagagaccatatgccaggcagtaaaacaagcctcaagaaatttttttaaaaaactaaaatcctataaagtatgttctctgactacaatagaatgaaactagaactcaataacagaaagtttgggaaatttacaaatatgtggaaattaaaaacacatccctatgtaaccaatacatcaataaagaaatcacaggggaaattacaaaacacttagaggcgagtgaaaatgaagatataagatgttgaaacttacgggatgcagctaacgcggtgtctagagggtattcaatagctgttaatacctctgttaaaaaagaagaaagattttaaatcactagcctagttttccaccttaagacactgaaaaaaggagagtaaattcaatctaaaacaagcaaaaggaagaaagtaatagagattaggtcggctattaacgaaccagaagaaaaacaacagagaaagtgaacaaaaccaaaagttgtttctgtgaaaagatcatcaaaattgacaattagctagactgaccaagaaaaagaagactcaaattactaacatcaggaataaaaaagatgacaattctattgacctcacagacataagaaggattataagggaatactataaacatttatatgctaataaattcaaaaaacttagacgaaatgaacatgtttctaggaaactcaaactactaaaactgaatcaagaagaaatagataacctaaatagacccgtgaaaatgaagaggttgaattagcagtttgaaaacttcccacgaaaatggcctaggcccaaaagccttcactttttaattctccaaacatttaaaatagagttaatacaaattatttttttttttaaagaaaaagaataggagggaacagttaccaaggtattctttgaggtcagtattacccagataccaaaaccaaacaaagacatcataaaagaaaggaaaaaaaaataggaaatagccttaaaagggcaaatccaagtgttgttggccttgaagaggtggtagagagacaggagcagaacgtttattcaaagtgataataacggaggactttccaaacctagagaaagatattaatatccaagtaaaagaaggttctagaccacctagcagatttaacccgaagaagacgacctcaaggcatctaataattcaatcatgaaggtaaaggataaagaaagtttccaaaaagcagcaagggataagaaacaaacaacatacaatggagctccaatacatctggcagcagacttttcactgaaaaccttacaggccaggagagagtgacataacatattgaaagtgcctaaggaaaaaaacttttaccctagattagtatatccagtgaaaatatctttcagacacgaaggagaagtaaaggctttcccagacaaacaaaagcagagggatctcaataccagatctgtcctacaaataatgccaaagggagttctttaatctgaaagaaaataacattaatgagcaataagatgtcatctgaaggtacagaactcactagtaatagcacacagaaaaacacagaatattataaaactgtaattgtggtgtgtaaattactcatattttaagtagaaagatgataagataaactgatcagaaaaaataactacatcaacttttcaagacatagtgcaataagatataaataaaaacaacaaaaagttaaaaagtctgggtgtagtggcttacgtctataatcacagcactttgggaggccaaagcaggcaaatcgcttgagcccaggagttcaagaccagcctgggcaacatggtgaaactctgtttctacaaaaaattataaaaaaatttagctgggtgtggtgatgtgtgcctgtagtctcagctactcgggaggctgaggtgcgagaatcacttgagcccaggaagtcaaagctgcagtgagctgtgattgtctgcactccagccagggcaacagagtgagatactgtctcacaaaaagaaaaaggtaaaaagaagggagacaaagttgaagtatagagtttttattagttttctttttacttgtttgtttatgcaatcggtgttgtcatcagtttaaaataatggattataagatattatttgcaagtctatggtaatctcaaatctaaaaacatacaactggtacataaaaataaggagcaagaaaagaaacaattccagttacaaagaagaacaaactagaaggattcacactttcttttcttttttcttttgagatggagtcttgctcttgtcgcccaggttggagtgtaatggcacgatcctgactcaccgcaacctccgcctcccgggttcaagtgattctcctgcctcagccttccgagcagctgggattacaggcctgtgccaccatgcccagctaattttgtatttttagtagagatgaggtttctccatgttggtcag

SEQ ID NO: 695 - DNA, 2431 bp, Homo sapiens
aattggcaacctaaagttataagttagatgtattttgcttttcaagccatcttctgagccttttttaggctgaaatgatttgtttatttcccaaattattgctagctacttgattttttatggctacctaacatccacatttggtagatacttttcctctctgcatgcatcccaaagaagaatttgctatttgtggaagaagagaataagggtatcagaatgaaggaaattacagtgactacactgtttatgactccattttgtgaattcttaaatatgctatggatttttttttagaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttgtaccagagcaaaatttgtatttaaaacaaaaaataagaatgcccatcactaggagaaacactcctcacagaaaacacacacacacacacacacacaatttaaaaactgagtaaatttaaatgtatgaaagtaccccacaaattgatttcaacaaataaatttcatttctctagctacttatgtctggccttattttgagcgttacaattttattgccttcatttgcctatttagactgatgtagtttgatatgatgaagttgtgaataaaagccttgtgttcattatttatatatactacctggtatgctatggactgtgtctgctgtagtgctattccctaatgagcaactaagagaagacacaacaataaaccatggaagtgttgggaggccatggaaatgatttagaggtataaaatattcccaagtttttattataaatttttattcataggttaaaacatataagcataagtgattgtacaggtgtgactcccttttctaggagagaaaatagctttatttgaaaactccaaaagctacttaatcttaccagaggtttttaataggggaactgggtttacttacaatgaaagcatattttcattctgctatagaaaaacatatccctgctcattcagtaaatctaagattggaatgctttctagaactatgcaatatttgaataatttctagaaatgtctaagaaacaaccttttttattttaaatcatcacttacaaacgtagtctgagactgcaaactagttttcacttgactaatccatcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttatacccaactagataatagtagcttctagacatcaataaaaagatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatatattcatgatgacaattttgttacttacactgcctattctttatttcttttttagttcaaaggtgaaattttgacctttgtattaacaaagcctcaagaaaagagaaattctgccttttaaacattggttttccttgcattttatggtggtgtgattttgcctcagcaataataaaacataaaatatgttgttgcatcaa

SEQ ID NO: 696 - DNA, 1686 bp, Homo sapiens
gaatcaatgggaaaataaaaaggaaaatccagacattaaagcagcatttcatgtcatcaacatgggtggcttctccaccttcctcaaagtagaatagcaaacttttaagttcccaaggtgtttacctacttagccacacataccatgggcccacttctcagtggctttgatatacctagcatggtctaaagaagtgtcagactaactcatcttacaaaaggaaccgcttaataataaaagagctgtgcaagtagcttgtttcatcttaattagcccaagatgatgcttctgaagtgctgtgctttcttatctatccttcctgctgcaagggaagaagactttgacatctttaacaactcagcctcaggaaccagaatcaggagtagcagatcttgcattggcattgtcaaagaagctgtaaaaatgggtgcctaaaataaatttgcctttgtattggaataagctgtcatgtgcaatgtgagagggctgggataagctatcatgtgcagtgtgagatagcttactgtccagtgtgagatagctggaacaagctatcatgtgcagtgtgagagggctggaaagtgacttttagcatctgtgttcaacagtggaaatcacacatctactgtgtgataggaggatgccagaccctggaggggagaaaaatacagtgcctctgccatcagagaatctatgttgactgcattagaaggaaaagggaagcaatggttgaaagtgaaaatgtagatgatgatatttttactttagaaatgcattagtcacttgtaagaagtctgcccacctcttttcaattattgcttgagaccaatgttagtcaacaggttagattcagaaagcttcagaggtctctctttagtattttgtttccacctggcaccagcaacagtgtcctcagtggccttgagtgtttgcgcaaccagaaaataggagtggaaatgccccccgctgcaattgaatcagcatcccatgtaacctgccagctgggtagccaccccgagcctctgccattaacttcatttacacattgttctcactcagccactcacaggaaggcatctttatgaaagcactgcaaacactatgtgtgaaaaaatccagatggtataaatagcttttcacttctaattgcaacttgcccctcacattttgtttcctgagagctctgaaaagagaccgatccaaaccactaatagcacaggagctctgggagggtgagtcagtgtctactgctgaaggagaacaaagatgaagagagaacggcaggagtcccagaaggccatttcaggcttgaaggagtacttttctgcagggtagtgcccagccagacaaacagggaatggtttcctggagtacctgataggtcagctctttgatgcatcgctcaagtctgcgggctcccctctgggcctctgcactgcgacggatttcaccctccagttcaccttccagttcacgaacctgcaaccaaaacgtgacctcagaccagacgctgccaccaagtctggcattctatttgctgattggcacaatcatttgaaagacagcaaagtgtcaagggaacatgcacacactgtttttggtgcttaaacaggacagtgtctctgggaaaactctctcgccaaaagtaagatcttttatggattcataaaagaactatttagactg

SEQ ID NO: 697 - DNA, 2213 bp, Homo sapiens
aggggaaagtccctttcacaactccctagaagcagaatgtcctaagaattttatggcattacctacttccaattctgctcagatttatagtacatattttttatcaccctgacaatttcttagtgcctagagagtactgatgttcttcagcagctggaacatgatctgtcttcaaccagaaatgatatgtgattggttccttcatcaagcccaaagccaaaggaatccagcccataacctctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttattgacacttctgctcacaggcatgttccagctcataccctatgccccttccttatttggaaatgttattgcttcctatggtgaccagaatgtgtggcatttgagccatcagcccctttccctgcagccctcccagctctcatggaagctgccctggggactccagtccattggatgcagtgaaaaatcgaggctccttctgtctccatctcccagctgggaatatgtctgcactgcaagaggagcagcatgccaatgcttctgtttgcctctgccccatgttgcctgcaatgcggacatattcccagctaggagatggagacagaagaagccccgatttttcactgcatccaatggactggagtccccagggcagcttccatgagagctgggagggctgcagggaaaggggctgatggttcaaatgccacacattctggttaccgttaccaaatacagtaaatattgtttaatgaatatttctccatttgctgtatgtccttagaacagtttccacagactttttaaaaatcatttactccagtgaaatcattgctttgctgctgagaattctgttgcactcttctctcttcccatctggaaccccattacaacagatgaatggataaagaaaacgtggtgtatggacccagtggaatgccatgcagccatagagaagaaggaaagcctgtcatttactacaacatggatggatctggaggactttacgttaagtgaaatcagccagttacaggatgacaaatattgcatgatttcactcacacatggaatcttctaaaaaatgatattatagaagcagagagtaaaatagtggttaccagacactgggaaggggaggagatggggaggaggaggagaggttaatcagctcagctctggctctgggaatcctgtctgcagtggccaacggggtcaaggggcgagtgcctgtgggtgtgagtttgtgtgcggcacctaggggttggctcatggggcatgtgtgggtcctttgtggggagtacaggggctggttggctgggggctggtgtaagacctagcagtgtttaggtaattccttacctaagtccatgtttgcccaagactagggaggacagaggaagcttgtgttgctgatatcttaacctcagccagtgctcatcaaggccaccctgcaagctcctatttcccaaatgtcttcatctgtaagggctgccatagcaaagccccatggacagggagccttcttaaacaacacaaactcttcctcacaattctggaggctggaagtccagggtcaaagtgtcagtagggttgcatcccctgaggcctctctccttggtttacaaatggctgtcttctcccgtgtcctcatgtggtcttccctctgtgtctgtccatgtcctcatctcctctcttatgaggatactagcaagattgcattaggacccaccctcctgaactcattttactttagtcacctcttgaaaggccctgtctccaaacagtcacattctgaggttctggaggttactactttaacatatggatttaggtggagcaaaactcagcccataacactaactttcctgataacctgaagccctgagaagttgccacttgtcagccttctgctcttgaccagggcctgccatctctgcagctgcctcccctgcctctaccccagtccccatctgggggctccatggaaacagctgcaccattaacccctgacatagccccaaatctttcactgcacagacca

SEQ ID NO: 698 - DNA, 3151 bp, Homo sapiens
aaatattattagtatagtgttcaatcaagtaggaaggggtttagaaaatgcaacaagttgataaaaatgattgactttttatttctttttagaattcctgactcttatcataactgtgcattttgaaattgatgttctaacaaccaatagtggttaaaatatactatccacttaattacattcaattatggttatagtagcatgtctcattcaaagaaccagatctacatggatgcatacttaaaacttatttatcaatttacttcacatattcttcccaataacatccttctgtcctgtgtccctttttccttcctcctgtccctccccccttcttcctttcattcctccttccttcctcccatttctcttccttcctttctcctgtcctgcctccctctttccttccttcattgcaaatgccttatcctagactgtggctttttttttttattttttttaatggagtttttccatgaacagaagttcttcatattaataaagtataaatcgtctttttttattttattatcatatttgctttttctgtatatgtcctgtttaagaaatcttggcctaccccaaggacataaagataatttcctatgttttattcctgaagctttattattttactctccacaattcgtcctaagacatttaaaaaaataatgtttgcattaattattaattcattctaagacatatttaaaaataattatgtgatgaaagggccaagacttatttttccccactataatgttatactgataatataatatgatagtggccatttgtgtctttttcccaaccatcagaggacaaatatttgataatttaccaataagaattatgtttcctgttcatgttttatagatttttcttatgggattgagaatgttctatttttttttaagttatcctagggcagtgaagtctgtctcaaagattttggcatatatttacttaatcatatccatttttttcttcttttttcttattttgaattaatcaaatattttttcccatttactctcctctgttatctcttaaattttacatagtcttgtattaccttttttagggtttaccatagaagtttcaatatgcatctttaaattattgcagcctaacttaagttttgcttttgttatgttttgaacaatatctcataatttacccatgccctttttttctaatcttattatgttcttttatatatgtcagtctcccacagaatagtattattttgtgtataacactcattattcttgtatatttgcccacatatttgttctttctggtaaattttattttttcagcagtaccatactcacatctagaatcagttgagtccaggaaagaattttcattttctaattattattattactatcatgtttcttataggatgaattcactcaatgtttgcctgaaagcatttcattacatatttttactctaaattagctgtattgagagacaatacaaatccaataatattcaccaattttaagtggaatcagaacacataatttttccatcacctcccaaaatacccttgtgtggtttttgagtcagtctcctcctttttggctcagtcctttgcagtcactgatctactttttgtaagtatagtattttactagaattctgtatagtcacattcattgaacacaatgcatttgagagtcatttatattgctgtgtacaacagtactttagtcctgtttattgctgactagtattttgatataggggtataccacaatttattcattcattcaccagtgaaataaaatttgggttttttttgtttttgttcattattaataaagttgctatgagcatttatgaataaatactttttattacatgcttttaattcttttggaaaagcacttaaaagtgaaattgcttggccatttggtaggtataaagttgtataaaaagagcaaaatatttccccactggctataccattttacatccccatgagaaatttataagaattacagctgctctttatcctcatcaaaattagtattgccggtctttttactttagccattctagtgactgaagacaggtattctatagtggttttaattgaattttacctaataattgataattttgagcattttttgttatgaccattttcaattcctatattctttttgatgcactattaaaaactttaccttttaaaaatttgattatgtgtcttatgaatattgtgatataacagattttaaatatattctgaacacaaattcttgttcagatatatatttgcaagtggtttccagtttgtggcttcccttttctttttctaatggtgtctttgaaaaggcaaaaaaaattgatgaaatgtaatttattgatttataactttataatttgtggttgcctaattcaaggtcataaagatattttttctagaaattttataggttaagctcttacatttaggtgtattattcacttctagttaatttatatgaatggtgagaagtggatgatatttatttttccaaatggttatctatcttttctaagacaatatgttaaaaactatatcatttcttattgtattacactgatatttttgccaaagatttattgattatatatatgtgggtatatttatagactcttcattatgttcagttaatttatatatgtattcttataccaataccacgctgtcctaattactaattttagagtaatgcttaaagttatatattagaaagcctccaaatttgttgttaattttaaatgttgatttggctattctagattcttcatttacatgtaatttaaaaaatcaactaaccaatttctacaaaagggtttgctagacttttggttggaattacattaaatatatagatccatttggaaaggctagatatattatcaatattgaatcctatgctttgttaaattcttgagtattttataattttaggctactatatatgatacttctaaaacttttaatttctaaatatttatcatatatataaatgcaattgattttcatatattgactgctatcatttgaatgttccctccaaaacttatgttgaaatttaaatgccattgtactagtctaaagaggtgggatcattaagacctgatt

SEQ ID NO: 699 - DNA, 28468 bp, Homo sapiens
agcagcgcgagaccctcgccaggctctgaagacgcggcctggccctggccgttcggcccttcgtctgagcgcaaaggctccagcacctccgcggccgaagccgcgggacttttcgtggaaaatgggacccagcccgatcgccagcggcgctgcagcggactctgcgggaacctagcttctgctccaggacctccagggccaccccagctcgcagggcgttcgcagcggctcagggcgaatcacgctcatggtccccgtgcgcattttcagccccagccggtacctccttactcgccctcacgacattcattccaccccctaaaggtcctgccaaccccaggctcttcccgagcattcccgcccttcctcccttttgaaaccggagcaaatcacggccgggcggaagcgggggagcccgggtgagagtcagtgactcagctgcggactccaagtgtcgccggaggccctggggcgcaggcccagcgggctgtcgcacagctcggctgtcctgtgccccttcctgacgaggctggggaggaaaggcggcccagagaaggccggaccagctctccccgtcagccccaggctctcgaatgacagcggatgccagcgaccggggatggggtcccggaattgctgggttaaacaagctccggattcaggcctgggcctgggctggggttccagggttctggaccgccctcaaagaaggagctccctggggcggcacctggctctgcttgatagccccagggacagggagctcactacctatcagggcagctcccccagtgccgagaccagctcggtcctggagaccctaacccagcggtgctagaggaattaaagatacacacagaaatatagaggtgtggagtgggaaatcaggcgtctcacagccttcagagctgagagcctccaacagagatttacccacgtgtttattcacagcaagccagtgataagcacagtttctacagattatagattaaaagtaccccttagggaaacaaagggatgggccaaaataaaggggtgggtttggctagttatctgcagcaggggcatgtccttaagtcacagatggctcatgctattgtttgtggtttaagaacgcctttaagcggttttctgccctgggtgggccaggtgttccttgcccttattccggtaaacccacaacctcccagcgtgggcatcatggccatcatgaacatgttacagtgctgcagagattttgtttatggccagattttgggggcctattcccaacaccctagcattgctcacacttgtccctgaagtgtcaccttgtcgtagctgggctctgagccctctgccccagggaggggtggccttttgggctgaagggactgaggacatagccgttgagcctgttggccattgctcaaagaatgcagcctcctggtcacccatgttgtccccttgccaacaaaaagagtgaaacactgtgcaatgtttgaagagatttattctgagccaaatctaagtgactgtggcctgtcacacggcctcagaagatcctgagaacttgtacccagagtggtcagcctgcaactgggttttacaaattttagggagacataagacatcaatgaatacttgcaggatggacattggtttggtccagaaaggtggggacaactggaagtgacagagggacttctaggtcataggcagattcaaagattttctgattggcaattgattgaaagagttaagttgaccgggcatggtgggccatttctataatccttgccatggggaggctgaggaccatttgagcccaggagttagataccagcttgggcaacatagagagacctcacttctccaaaaaaaaaaaaaaaaaaaaagttattttttaaagacttagcattaatagaaaggaatgtctggttaagataaggggtcgtggagaccagtgtttcatgatcagatgaagcctccaggtagcaggcttcagagagaatagattgtaaatgtttctcatcagacttaaagagtctgttctctcagtctttaaggggtgtgttgatgttactgctggtcagctgggcctgaaatccaaagggaggagggtacagtgaggcatatccaacacccatttcctgtcgtggtctgaactagtgtttcaggttaaccctggactgcccttggtcaagagcaggggtgcattcagatggtgggggtgcttagaatttcatttttggtttacaccactgtgtcctctcctgccaggggagggacccagagctggaggcttagccctggagataccggtgaagatggatgaatgagaaaccagttggagcttccaaggtctctacccaccctccagacctcctctgctcctgcccctgcccattcattcccaacttctgctctcccagctcccctcccacccacatgctgttccctcctcttccatcttccgcttcctgggcccagagactgggcaagatccccagggctctccttgcacagcgaacctctcccagggtgcatagccttgctgcaatcttacacagggaatacataagcaaggaatacttctgtccctcttggactctgaagccagaaggccagggcctggttggcctcctaactgctgtgtcccagggccagagcagtgccagacacccagcagtcttagcacccacgaaagctggagggacccacaccttccccatcactcagttgcatcagtctaacgcaatggatttgggcagcttgtggtggttcactggcagtttattgggggacttgaaggagtcaaggtcaagtgggggacttctgggtgccagacctggcccttccttggcctgggcttggggtgtccaagcccacagagccatgcagggggaaagagctaggcaagcagggtggttgaggaggtcattagcgtggcctcgagggaaaacaattccaagaggagcccaaattcgaatgtcccctggtgtcattgagaatggagagatttaggttatgaattgtgcagttggtgggtagcaagccagggtcctgaagatagtctgcatatcccctggtgtcattgagaatggagaggttcaggttatgaattgtgcagttgggggtatcaagccagggtcctgaagatagtctgcatatcccctggtatatatcatttatataaggatgttacttaactattgctgtcttccagaggcagcttcttgaacaaatacttgaggtcctctataggtttacgggagtagactgttttctccaagcaggcctgtcgtccatcaggagaagcaaaaggttttattctagagacaagtccttccaactgtacagctgatggagtagccaaggaaacctggacaggaggtagcttctgacctttgggagccagaagggccagtaaatggattctcttctcggaggtactgagacttatattgcatcccctggagggaaactgaggctcccaggttggataataaatcataacctattaaaggaaggggacactcagggatatataggaaagaatgagtaatacccttaaatccaatttcacaagtcaaaggaaaggcaaatcattttaccttctcctggccatctattcccatcaccatacagttggcattgcagaggtcccacaggttgggtcaggacagagtaggtggtcccagtatccaatagttattcaggtttcctgcctgctacattgagagtgacctgaggctttgcggtggtgatgccaacagaacgcttcaagactgcagctgggagagcacttgggctacatccagcagagagggtggccttttcatacaagagactagcatcaagaggagtgggttggggagattcatgctgtcatgacttcacaggatggaatgaacagtcccttttccagtgcccctctttcttataataagaacattggttgtccctcagtcctattgctgctggttgaggtctggtcaccccttgtctggagtgtttctcctgcctagggtcaccttgaggcagacctgtaattatggcagccaaaatttttgcccgatttttcattctctcatcctttttttcctcccctgcctggtccttattgttaaaaaccttaaaggcctccgctatccacgtcacctgaggtgtcttggggtaagcttccagtttctgaacctttctccaaatgtcgggtggaacttgagttatgaaatgcatggtagttgtatgttcatttttataagaaactgtcaaactgttttccatagtggctgtaccattttaaattttcaccagctgtgtatgagtgatccagttactctgcatccttttcaggatttggtgttgtcactattttttattctagccattctcataggtatgtggtgatatctcattgtggcttaaatttgcattttataaaggataaggatggcctgggcgcagtggctcacgtctgtaatcccagcactttgggaggctgaggcgggtggatcacgaggtcaggagattgataccatggtgaaaccccatctctactaaaaatacaaaaaaaattagccaggcgcagtggcgggcgcctgtagtcccagctacacaggaggctgaggcaggagaatggcgtgaacccaggaggcggagcttgtagtgagctgagatcgcgccactgcactccagcctgggcgacagagtgagactctgtctcaaaaaaaaaaaaaaaaggataaggatgttgattattttttaatgtgcttatttgccactcacatctgcttgctgacaaaatgtctgtttatatgccttgtccatgttctcattgattttttttttttactgttgagttttaagagttctttgtatattttagataaaactctttgtcagattgtggcttgtaaatattttctcttagtctgtagcttgtcttttcatcctaataacagagtcaatagcaaagcaaaagtcttaatgttggtgaggtccagtttatcaattgttccttctatggattcagcttttggtgtcaattttaagaactttttacctagccctagatggtatctttttatgttttttagtctagagatgtcatctttttattcctgatattgataatttgtgccttcttactcatgatcaatctttctaaggatttataagttttattagttttttcaaataagcaaccttttatttttattttttgatgaattttctattagtttgaatttcttctttctgtggatatatttgctattctttttctaatttcttgaagtagatactcagttctctgtctttaagaatttttcccatgaatggattattttagaccacaagtttctcttaagcatatctttgtcactataccgcaagtaataataggtcatgtaaacagtataattcttttttggagaaacagtgtaattatttttggacactatgtcatgcaggttggagtgcagtggcatgaccatggctcactgcagccttaaccttctgggctcaggtgatcctcccacctccacctccatagcagctgggactacaggtgggcactaccacaccttgccagttgttaaaattttctgtagagacgggttctcactatgttgcccaggctgctaactcatgggctcaagcaaccttcccacctcaccctcccaaagtgctggaattactggcatgagtcactgtaccttgcctcagtataatttaatacaaatattttccaacttcctttgtgactgtcttctgagacttagaatatgcataaatttatttcttatcttccaaacctttggggatattttattttttgatatcggtgttttatttaattgcattatggtcaaaaacttgccacacgatttcaagtcattgacattgtggagatttgctttatccccagcatatggacaaaaatttgatgaacattccatgtacacttgaaaaaattgtgactttttagttgttcggtgcagtgccctgtatatgttagtgggccaaggttgttaatgatgttcaaatattgcatatttttattaatttgctggattgttctgtcacacactgaaagaagtatgttgaaatttaccatttcatcttttatttctgttaatgtttgctttatatattttgaggttatgttaacagatgcatacacatttagaattattgtatccacctgttggatttacccttttgcaattatgaaaagccctccattatagtaatgtttcctgtatcaacatcacttttgtctgacagtagaaactctgccagattctttcacttagtgtttgcctggtgttgactcagctccacaccaaccatccccactccacctctgtggctggccctagctccgcaaactcatttctgctgggccagctggtgctgtgctaaattctcccactaggggcaccagagaaagcacgcaaggctggggaagatggggaatgtgctcctttcagtttgcttccggtttctttcccaggcttccggtctacctgccactggggccacgtgtcctctggatgctgctggttcacctggcagtggcacttccccacctagctgctaaaactgggttgctggttcccgactctgcagaatcagcttgatctccccgctagagacctcaaaccactgctagggacacctcatctcgggggtctgggtttcaggccgtaggcccttccagctcagaccctggcagcagctgccatccctcttcagaggccagatcccagtgtggcagccgccctggggcacctggggagtgactcattttcatgaattccagcttattagttttattaattctcccctttgtaccccagactgagtggtggtggctgccttgtgtggttgctattttcctgatacgtgggctggcaaaccaaaacctgagaccacagccagctgcagtcctgtgttcctacaacctgtgagctaagaatgttatttattaagtagaatattaataaataaataataaactatactatagtatctaaatgtgaatttttttttttttacttaaagcatcttccatagatatatatgaaattcaaatacattttattgggacacactgttttaattcattttcatatttattgcctcttagcacaatgcttgagccttggaatacttttaactcctttcattcctctgtcaccttctgtgttactgtggtcacatacaattattcacactacttatattcattatattaaatctgctgtatgattttttacttctatatattatatccctaaagtccttgttattattgtcttatacaatagatttttatttatattaactaatattctttccattgcttatgtttgatataacttttcatccacctttaggatttcctttagtgtggtctgatggtgatacattctatgagagtgtgtttctttcactttgtctttacttttgcattttgaagggtattttgttttgtagaacgctctagaattagcagtgattttcttccagcagtttcacaatgttcttccattgtcttttctcattgcttactttctctttttggaacccgggtattattcttattgttgctcctttaagtattgtggctgtttgctctgactgcttttaagactttctctttattcttgggtttcagaagttttgcaatgatgtatccaggtatgatttttccttgtatcaattctgcttcagtttctcagagtttctcaaatctgtggttattttctatcagttttcaaaaatgatctcctgtatcttcaaatattgtgtctgtccctttctcttagtggatccatggtctatcagttagctactgctgcataattagccgccccaaagcccactgatgtgaaacatccatttttgtattatcactcatggatctgtgggtaggcccagctcagctgggtagctccgcttctcactacagatcttgagtctactgggatggttctacaacccacgtctctcttcctcctggtacaagtggtctagctgaagcattttcttctcaggatgatggtgggggcacgagagaaatcccaatcacacaagctcatctcatgtctttgcttgtgtcacttctgctaatgtcattgcctgaagcaagtcatgtgacagtatccaacgtgaatatcagggaactaaaccaagtctttggctggaggaactgcaaagttacatggcagagggtattgtatagcaggggtccccaactccacagtccatggcctatgaggagccaggccacatagcaggaagtgagtggcaggcgagcaaggattccagcctgaggtctgcctcctgtcagatgagcagtggcatcagattcttgtaggagcacaaaccgtattgtaaactgtgcatgtgagggatttgggttgcatgctccttatgagaatctgatgatctgaggtggaacagtttcatcccgaaaccatccttctgcctcatccatggaaaaattgtcttccatgaaactggcccctggtaccaaaaaggttggggactgctgatgtatagcaaaggctgaagaaacagagtcaataattacatcgacttatatacaactatgccagaccttgtctccatgtcccaggtaccaaggctttttctgtattttccattctctttttaaattttgtgatcttcagtctgatggttcctacctaccattcttcttgtttactcttcctttctctgattgtctaatatgccattaaattcacctcttgggcctttctgtcatacccttgatttctatttcattaacttctaccactttgttattttcttcatacctactttctgacttttaaagcggaattttgttgttgtttgcttttgaagtagggtctcgctttgtcgcccggctggagtgcagtggtacgatcacggcttgctgcagccttgacctcctgggctcacggcatcctcccatttcagcctcctgaatagctgggactacaggtctttccagagacacatagaaggtgccatctatgaggaacaggccttcaccagacatcaaatctgttggcatcttgatctttgacttctccaccgccagaactagatcaagacatgaaacccatgttcaagatactttccagtgtgtcttcatgtgatcctctgagtccagccatcaggctaccagcagctcttggaaaccctgacatacttattcttagaagactgctttccggactcaaagtggaacctcaaattttcaattttctttgtttttaaagcctacacataggtgatgatatatacatgcatatatattttggagaatttataattctgaaaacaatgctggtcttatggaacccatccattcccctttccccgtgtgtgctccgagctgtggtggcacgtgaaaaggggtccttccagcagtggcccacagccctgggctgcttacttgctcacttcatttacaagagcaagaaatacacattcttgtgttgtttaagtcattatgatgtggggatttccattactcacacacctgatctagtagtaacacagtagcctattttagcaatatcatttattcaataatccattctttccccattagttttgagccttcatttattgtgtactaagttctggttatttttagtggttgtaatctccttctttcctactctcttaatcatgggattgccaatatctgctctgtgtttctgtgccatctatagcctctggccttggtactgcttcaaaactgatatttctaaccttactttgacttctccattcagtgaagttcccatagttcatcactcaactgctctctttccatcgtgaccttctgaactagctcacacccagatgtacttttgttatctgcctttccccctcataaacatgggctgctgctggggaaaatccactaccgaactcttgcaggtctctgcaaatgtttaatgccctgtcttagccatgacctccacaatgctgggctatcctatgttatgtcccctaagatatcccttctctcttacctttggggatagtcctaagcttccatcatggcactcaaagtccaaccttatttgtaccctcattctctgagcagacaccaccgtattctgtttcacagagaaaatgtgactgctggggataattctttcaacttcctggcctcttcctatacatgatctttctctgtattcttgcctattgctcttccatgttgatagaagtgtctgttctccttgtcagtgtctcggccttggatctgtcccctagactattctgcctgtgtaaggaccttccctgaccagctgggccaccatctcctgcttctccaatccctcactctagactgactcttaacctttggtcaacaatacttgagcttttacattcataatggagcatctgtgttgaaccttgttcttttctagacactaccctccgttctgtcttccatccatggtgacttttctagaaagagcatctatcacactggagacagcaaactccttgatccattctaattcctaaccctgcaataattttctatctcccttactcaagtaattgggagtgctcctagtgttaccagagacccagcagttcccaatttcgaatttttccgtattcacatttcttgacttgctatgattttacatcacagattacatccttcatttgaagagactctaatggaaggctgccatggaaactctctcatgtggctgacctcctacctcacttgctctttctgaatgaagttcccacttttgcctgccttaatgaaagtaatgctccccaaactcaagcccagggctgcgaattggaagcagctggggctactgtttctgggtgctggtgtgaatggcaggatgtgaacaccagcctgtgacgggcaaaaagatggacacacaggcagagcctgacaggtgctggtggtcctatctggtcctgagttgctgggaccctccttgcccactgcccctagaatggactttggcctcaggttcgaagtgttcagatgtgactgagatgagccttttccccatgcctcaggaatagcgaagaaactctatctggaaggttccccaggcttccccacccagcagcctctggtattagaccaggcagtggctggccaggatggtggggacagaagggagacaaaggtgagcagtgggtggggtcacatcctccctgacattgaatagacaacatggggaggaaggatgagtgatctttagaatgttcatggaaaatgcatattgggaaaaagaatgcatgaatttcaaattgttttgcaacaaaataaacttgtactaacttgtgaaaacacgtccgaacaggatctagtttgaggccctaagaagtataagacaacagtttgaacagagctcctatcagacacatgaattctgctaaaattgaaaccagaacaaacatgcaattgatggtgaagcttggctggaaacatggtgaaatcattgatgatttattgaaagtttatagggacaatgcctcaaagaaatcagcaatttaagtaagtggataactcattggaagaagagaagagatgatgttggagaggaagtccacagcagcaggccagccacatcagtctgtgaggaaacaattcatcttgtttgtgccctaatttaagaggactgattaatagcagcagaaacaatagccaacgctgtaggtatcccaaggtgttcagcttacacaattctgactgaaattaaagttgagtaaactgtccactcggtgggtgccaaaactttctcccagctcagctgcagataagagaaaagcgttctatggccattttaaacaagtggaatcaagatcctgaagcatttcttcatataattatagccggagatgaaatgtggcttaaccagtacactcctgaaggcaaagcacaagcaaagcaatgactacctagaggtgggcgtggtcccatcagagtaaaagcagacatgtcaagggcaaaggtcgtggcaaccgttttgtgaatgctcaaggcatcttgcttattgactttctggagggccaaagaacagtaacatcttattatgagagtgtatagagaaagtcagccaacgatttagcaggaaaacacccaggaaatcgtcaccccggaaagcttcaccagagagcccttctccaccatgacaatgctcctgctcattcctctcatcaaacaaggccagttttgtgagagtttcaatgggaaatcactaggcatacaccttccaggcctgatttggttacttctgttttataattttaaaaaatctttaaagggcacccacttttcttcagttaataacgtcacaaagactgaagtggcatggttaaattcccagggtgcccaattctttagggatgaactgaatggctggtaccattacttgcagaagcgtctcgaccttgatggagctcatgctgagaaataaaacattttttaatttttatcttttaattcaattttttcgtgaacttttgaagtccccttgtatttgtttttggtggaactttgagtctgatttctcagctccccatggatggctgcatcttaacagagaaatgaacgccatttaccctgatgctctctacttggcctaagtttcagatgttgaacacacacgtgtgggaatttatgaatctgtgcacctgtgccagctggtgggtgaagtctaagtttcttcaacacaattagttatcttctgcctcctggaatctggtaggaaaggttgaggaaaagcagccatccacagcgcctccaccactggaatgggggcagccctaacgtgtgccccactgccccccatgctgaggagtccttcactccagggatgtcttcaccccaatcattcagactcccccagtgttcctgcgtcacctgaaaggtcggaagcatctcagcacatactctccatgagtggtacttaggcctccctccccatcaatactgaagccctcagaggcagaggggagtcaaggaaaagagtggccatcagcaataaatgagttacaaggtttgatttcaaagagaaaaacttgtcaccaaaatcactactcaggagatctggacttcctctgaatgtgagttaaagaacccttgagggttaagagccaactgcacctgatccccactctcccatcccaagaccctgggaagtcaaaccaagaggtaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatatttctaataggaaataaagaccgagagaaggcaatcacgcaattccaatgcctgacaccgaggcccttctgtctgggtcaaagcctcacccctggcggccctgctcaaaggtgcacagtcaactggggcaccaagggggagtcgggaggacgagggccaggcctgtgtgttgaatgctgcttcagggaagggctggcttctgcgtggtatggcctgtccatatgcactgggaatgcgggtctaggggttgctgtttgggaacaaacaggtctcaacttctcaaacacagggttggctcaggcctttgtgaccacagacagacacatgactcccagccattctggccatcacccagggtgtggagctggcctcttggtgggcctggctcgactctgagctgggggtcttgtctcatgaccacacttcatcttatacatcactgtacaaatcattttgccatattaagttataaagtcgatgtgggccacactgagtctgaagcatcacctcagcaccccaccaacttcgtggataccgaagggctggagagtgactgctgggcggaatcagaattcacgagccctgaagatctccctgtgggcagaatgtgctgggtgtccagattccccttggggagggcttcatgtacccagaggttttcaggggaatcacagatgacagagcagtggtctccacaatttttaaggcatgcaccctcctttgagaacacacttgaaggctgtacaccttggttttgtgcatctcttgtaagagtgacatagacactgttctctgtggcgcatttaacactattaaagcttaatttttcatttaaaaatggatgatatgaaatccagattttcttcctacctcccagtatttcatctggacccactgtagcaggcactgccttacactagcacagttcctacacctctctctggcctctgaggactttgctcttcacattttaaagggaaaaaaaggcagggcgcggtggcttacgcttgtaatcccagcactttggggggccgagggcgggtgggtcacctgaggtcaggagttcgagaccagcctgaccaacatggtgaaaccccacctctactaaaaataaaaaattagccagtgtggtggcgcgcatccataataccagctactctggaggctgaggcaggagaatcgcttgaacccggaaggcgaggttgcagtgagccgagatcacaccactgcactccagcctgactccgtctcagaaaataaaaaaaaaaaaaggctactttctattagttattccccattgaggaaaactagacagccctgattcctgaaagccctctgttcacctgcctttgggtccccaacaagagcgaagatactcactcacggccgctataacgcagtatggctctgtccatttgcacctccttgggttctggcactcgaaagtgttttctctctcacaaacatgacaccacactctattgtcaccctcgtctgaaaggaggaataaaaaagaaagcagaatgttccagttctccgtgcctatctgatgaacacagccggcatccgaccagcacaaactcggcgggtccccatccttctccccctgagcagtggctggggccacatgactcgagtgagccgcatggggagaaagcaggaggggtctccggccacgtaagagctgcccgcttccccttcgccttcccccatgattgtaagtgccctgaggcctccccagaagccagcaccacgcttcctggacagcctgtggaactgtgagccaattccacctctcttctttataaattgcccagcccccggacttctttacattctgagtgatttttcttctctcctgggggctcccccgtcctcccacatccaagcacacaacatgagcgcacagcgcacccccactcggccgcagcaccctgaccccaggtcggccacgcggcacccacgggccctggcatctcccggccgacggctgtggaagtgaccctggggcttgggtctgctcccacgtgccctcccgcccacctcccaggtccacccacctcccaggtcctgccccccgactccctcaaaggagttctcccttgggtctgggttgggcctggcctagctctgcaggaggagccggccctcctcccgcagcttgaacggttctcagcccgtgaagcccccggaggccaggccggcgggagcctgcagcctgagggctcccggggaagcgcggccggagcggggcaagggctggggaagggccgggctcaggctgccccgccgccctggtggaagccgcacgaggcgaggctccccagaggcttccaggcgccacgggccgcctgaacgctccgttctcacggcctggtcggggcggtggccacgcggtgccaggcagacgccgcccggccctgtcctctcggcccgtggctgtggagggcgagccaggctcacccgttcgctgggagtcctctggatctcgttgtctcgcagtcaggttggcgtctgtccacacccgcggtagggccacgaccagcagcaaggcgagcagcgccatcgtccccagcggtgcccagggagggtcagcgcgcggcgccccctccccgcccttctggaaccttcgcagcctccgcgcgcctctccccgggtctggccggtagggggagccccgcccgccccggggcgcgcgcctcccacccgccggggcctgtcggggtctttggagcctcatctcagggcctcgcggccgctggcggccctgaacgccggttctgagtcccgccttgtgctgctgttggagcggccggcggccaggcaggaacgggcgcgggagccctgggaaaggcgcgtgtggaaacgcagcccctgagcccaagggccgtctccttgaggaccccacggcccacagaaagtggccggcggccaggtaggggatcttctccgctgaagagcacgggctcacctctgataactcgcccctgaatagcttttagctcattataataccaaaaaaaaaaaaaaaaacaaaaaccacatccctggggagagattccagatgctaatgacacactccagcgcactagtgtgtgaggtcacggtgcctgcgtgccctgaggacttcccaaaacgtgcttactagtaaggcccctgcctgggccgttcgtgagtaatcctgtaaaactctcatcaagagggtctccccagcgtgagtagcgactgactcattcttttgagcagttcctctttcaagctgtactgttttccttaactaaaagctcaaataagaattcctcctggcgcctgtagtcccagctactcgggaggctgaggcaggagaatggcgtgaacccgggaggtggagcttgcagtgagccgagatcgcgccactgcactccagcctgggccacagagcgagactctgtctcaaaaaaataaaaaaaaaaagagaaagaaaagaattcctcctaagtcactagcttttggctctatctcctgagtggcaggttctgtcttgtctctctgagatcctgactctttaaataaaggttacttaaccctatacctcttgctaggcatctcttgtctgaattccttcctccaagaagactaagaactggaggatttccatgcctctcacagtgacagtgctacccaaacatcagggttgtcatctaggccccctgccctgcacagaaagccaatcaccaacagcagtgccagggaagaaggcctcattcaagtgctacagcccagagatgggcgctcagtcacaaatccctctcctcagcccactaaaattagaagtttccagagcagggaagaaatgtcaccctgtgtgggaaaacaggaattagggagagtgaggaggcagctaggcagtcatgactggtgaggggtctggcctcaaggacctactgagtttcagcgccttgatactgtctgggaggcccgatggttggtttcctgagaaaggagctcagataagacaaatgtaactttcccaagttttaagacagggtgggccaatttctatgtttattcaaaagaaaccctaaatactagttttacgagaaattgggcccatgtgagtaggccccaaagggcaatccacaggtggtgttctccaccctgctttctcctctcaaccctctgtatagaggccctctgttaacacaggcaggagcaggaatttcacactcttttcctttctttgctttcttctttgtcttttttttttttttacagttgtgatatagtttggatctgtgtccccacccaaatctcatgttgaattgtaatccccagtgttgggggtggggcctggtgggaggtgattggatcataggggtggtccttcatgaatggtttagcactatccctttggtgctgttcttgtgatggagttctcacgagatctgttttttttaaaagtgtgtaggcaactccctttcttcctcctgctcaggccacgtaagaggtgcccgcttcccctttgccttccatcatgattgtaagtttcctgaggcctccccagaagccagcaccatgcttcctgcacagcctgtggaactgtgagacaattaaacctcttctctttataaattgcccagcctcaggtatttctttatagcaatgggagaaaggactaatacaagttgcatcatattccatggcctggatgtaccatagttaatttaaatagcctccttgaatgaacatttgtgttgttcacagtgtttttatatctcacatgtcaaagtcaaatacattataggatgaatctctaaacgttttattcaggaatcacagaattgtaattctgggcgtacacagaccagaaatgtgtttggtgtgtctgacgaacaaagagaaggttgaaagttttatttaagaaatgttacctattgtttagaaagaaaacttgtgggccctggtagaggtttggggagctggcaggctctgatgggtgagtgacacagtaggtagaccttgtctttgagtcacggcaggtcgttccagcagctgttaggtgcacctgattgtaaagttgcagcaggcgtttcagcacttgggcttgcagatggttcttggagcaggtgctgtctgcctgagtggttttcctctggccctctgccttgacttagtcgggtatgaccagaataactcaatttatgaagtcaactttcatatacatgacgctgcaattgtccctaatgtcattccttacatataccattataccacagctttccagaaatgagatcaagggacaaaagttaaatatatttgcagtttatatgagtattgcccagttgctctatctggtctttggacaattttgtcattgaggagtgagtgcttgttttcatggtggtgtcagaaagaatgtcctcttatttactctttggattttcaccaatgtgacagatgaaaatgaaaatagtatccgggtgtatttttaatttgcatttttaaattataagtgagcttgagcacttgatatggtttgatatgtttgatatggctagtggatatttgcattttcctgtgatctctctatttatgtctctcgtccattttcccgtttaacagacattgcttaacagaagacaatatttgagttgctgaccaatcccgaaatagttgtgaggtatgatatcagcaggacttgttttccgagccttgatcatgaccctgtgatcaaaacaggatataacaaagaaactggcccaaaccagctaggaccaagatggtgacataagtgacttctagttgccctcattgctcattatatgctaattataatacattctcataagacaccacatcagcaccatgacaatttacaaatgccatggcaatgacccagaagttatatggttcatatatgatgccaaaaaggctcattacaatggatcttgggagtaatttttcaaggaatatgaacaaagtcttccctctgtggttaattcatgaatgctgtgttggaatattctggatggtccagactttcctctgtaatcgacgttgagccctgcacaacttcaggagggcgccagacctcactactctcaaggaaaaggctgaagtggaggaattgattcccactgatttttttttttaatttttttgagacagagtcttgttctttcaccaaagctggagtgcagtggcatgatctcggctcactgcaacctctgcctcccaggtccaagtggttctcctgcctcagcttcccgagtagctgggattacaggcatgagccaccatgcctggctaattttagtatttttagtagagacagggtttaccatgttgaccagtctggtctcgaactcctgacctcaaatgatccgtctgcctcagcctcccaaagtatagggattacaggcgtgagccactccacctgaccttgattttatttttaaccatcctgtctgagagattatttgtggaggctgacagcagatgtgcagggttcaacagtgcagtatgctgcatttcttcagctatacctcatattgtaaagactgtccaggtaactcaacaagcgggaggtaagggttgcaggtgggatactgtagtacaccccattggtctaaaggcacatttccttcttttccacccactgttgcagtccagccaggcataactttaggagaatgtggttaggtaaacatgtgccatttggcacagggatatttgaatttcctggcatgaggagtggcgggacttggactagctaaccatgagagtgagttagtagagatgtggatgccgtcatgctgatggcctgctcagagtagcactgggctgtattcgcccaaacacccaacagagcctggccaaatgcaaggcccagtccggtctggggacttctctggaatgcctgtgccagtataaccgggaatgtccctcaaacagagagaagcaaattattatctcttactgagccctttgctaaacaagaagcagagccatgtggacctatgagagatctggagacacaacattccccattgaggaatacaccgcccttgctattctgaattcaaatgggtccctgaaccaataaaagcatgaatgtattttcaagaggtggtgcatgcagcttcatgcaggcctcctgagccagtcgtccagatgtggttaggaatgtctgctatcaggacacttgctgcctgggaacccttggcagaggccagcactgccacccagcagggacctctggtgtgttgcagctgctcctcaaatgcctctggaagacaatagcaacttacgacttccttaccaggaaacagcatcagatagccttcaaaccagaaatgcctctcatgtcttgatgtcagagaaccattctaccaagaggaggagcagcccagcaaagtccatcaaacggtgagagtatattccagagcagggggcaggaggacgttaggggagcctgtggcttctgcagcagaggcaatagcagaaggagaggagagggaggagcagaaggagagcagagggagagcagagggaggagccttcaagggctgctgtgtgttcggagcccagctaaagccaagcaggcctctgagctccctgctaggagttcatgtctgcagggcatgtggctgcttggaaattagccatgtagacctcacagtctgtctttgccagagaaaggcagggcaaaccatattatacacctttataacattgtttcaaatccagaagtgtgatgcctccaccgttgtttttctttttcaaaattgccttggctattttttttttttttttttgtggttccatgccgattttggattttttttcttttctctcttttttgatggggagggatggagtctcactttgttgcccaggctgcagtgcagtggcacaatcttggcttactgcaacctctgcttcccgggttcaagggattctaccacctcagcctcctgagtagcttgagactacaggcgtgtgctaccatgcccggctaacttttgtgtatttagtagagttgggattttgccatgttggccaggctggtcttgaactcttcacctcaggtgatccacccacctcggcatcccaaattgttgggattacaggcgtaagcaaacgtgtccagccagatctttcttctatttctgtgagaaataccactgaaattttgatagggatcccattgaatttgtacattgcttttgatgggattactagagaaacaggagtgtaggagagccagagtgacgccattttaaagccaattccattttaaaacaagcaaggcaattccttgccagtcacagcccatggtcacaggtgttgacagctaaggagggagtttagtaatgcctgcaaggactaactcctacagcaacaaaatgtccaaatgcgccaatatctaataacaatatgtgcttttaaaataattagaatcatgctttgatgtacttactcactaaaatcccaaggatagtttactttaaatcaacaaagtaataagttttgtcacgctgtcaacccacccacacatagacttaacttagcttttacatagataagacccctacatgagaggagtttaaaacaaagacaatgcgttcctcctcttgttttctgaggatgccctactctgcatctgagtagctttcaataaatgatctcttctcactgcactctgtgactcacctgaattccttcctgtgcaagactgaaaaaccctcttccagcaacatctttctggcgatgcactaagggaccataagatgagactatgtgctggggaagttttgtctgcagcaccagttggccacctctggtaaatggggtccttcttggcatcctatgtcatgcttagacaaggatgctcgcctagaaactcaggttagaggctcagcccacaaggttagatgccctggggtatatctggaacaatggaagtctctttgcaagatgtttgtcagtacatgatctgaactaatccaccttgtgccctctgctggggatgggaaagctctacttctcatcatttcccagctcattgctttgctgtactgcagccttggggcagccccaaatggctggtccagaggtttccaccttccagtggcggattctaatgttctttatgtgtttctctctgttcttttctgcctgctttggatctgctgttactaatctgctgccgagtggcaactctgcttatctcacggtgttgaggtgagactcactgtttttggtattactaattcaaggctacctggagattgtcttttcttgtacagttcagccagttctggctaaaatgtatacattaaaaactcatttaaaactgaagaaaaaaatgatgaaaaggttttttttttttttaaaccaaacttccttaaagactactttaccaaaactttggtccacagctttccttggattgcgtgttggatgtctgggtcatttccaattaagaaaagtttatgctatgggaaacatgtttctagaattgtggaagggtcttatctataaagtgctaacatctggcaaacagtgcaggatctcttgcttcctcagttttcccactcacggatgagcgagtgcgcttagctgtcccttcccttcccttcccgctctggtttcctgtatgcaatgtgctcagccttccaagccttgggacacacagggatgctcatgctcctttatgttcccctagggactaggggttagtggacctcacccagaggtgtgggatcctttgggttctgtctgctggggagcctggagccggggatcctccaggtcagccaccatcctgttacatggggctcttcagcctttcgggtcccagggctgcagtgccaccccagtggaaagcccatttgagactcagagggatatttgccagcatgtcctgctgggtctccctcgtccccttcattggctgcatatttgctgtctgtgcctcactagtgatgcccgtcatcctgagcttgcatgctctgaagtttatgcctgccattttccttctcctggtgattttctttctttgggttatttaattcagcatgtctctgggcagcattggaggccaaaagcctcccaggaactagtcttattgagaagaaaaataattttgtctaattcagaagttatctaaaggtcaattcaaatgatgaacttgaaaatagttacttatgaagcaaggtagaaaggagccagtaagtaggggagcgagagatgtgaataaaagttatggatatgaagatgtatttttggtaaggaaggttataaagaatagcaaataatgtatgaaaaaggatctcgtgtggtaaatttttgtcctaaagtaaaatgactaatgattattagtcattagccattaatatgactattattattagttattagtcattaatgactaaatgattatttaggaaagagagaaggttagggcaaggcagaaagtccaagcacatctaagatggtctgtgtacactgggataaagttcgtgaaggggaatttatgaaaggaattttgtatatgattaagttggttataattgaaaggaagccatttataacagtctttctaaaaattggtcgcctacgttaaaacaaagttttcttgaggtactgatttgctgtgaatgaagttacaagaaattttactttcaattttataccccgtttctcttctaaacttctcagatccatatttccgacattccattttttctgtctcactgctttcagctttttcccccttgagcaggcctgagatgatgaccttctccttcagcattttttgtcagctcctgcaccccttttttcctccagttttaactgttggaatgacctgatgctaaagttttatcttgaaggtctagaaaagcaatgttttcttctagtataacttgattttatattcttggcttttcttgctgtgtctaaattttcagtgtaatcagaaaacttctcatgctgttcctaagggtcacatatgctcataaccttaaacactgttcctgtgtctgattgcattcaagcacttctttcctcaagtttgtcttccaggttatctaaatgggcttcctgtaagaagaagcggtctcactgcagaaggttttccctgcctttttattagctggcttaaaaaaaaacaagattttatgtttttttcacgataattcctatactgtctttattagctttatgattgcaaaaaaactgaaagttaaaagggttaaggtttttacctccatgtgactttctctattgcttgttaaagtctttatgattattactcttggttaagtgtataactattacaatgacctgtgattttatgttaataaaatgttttgagccttttaacatcttagagaaatatcctcaaaatcaaaatcttaaatttagtctctgatttagtcttattgctggggcttattaagcctatagaaattaatctctgcaaggtcatagactctttctagaactttctggcagaccatgaagtccagtatcaccacctccagcctgaaaattatatattggaagaaaaatcagttaaaggattccctcagcccccttgaagctgtccttatcaagagttattaaccaatgcttgtgcttagttaataacctgttgtagggctttgactcctggacacacatatctaaagatggcactgacttctaccagtatctgacaaaaactcaagttaactgaaggctcgtctttagacctgggcaaaggggacaacgtaaactgctttcatgagacacaaggacaggtctgtattccaaaacattatgattcatttcataattttgcctttatctgaaataatataatttgttctatgtctatgtggaaggaaaatatcttgggcccccagaatcactaaggtagagggaaaattcaagctgggaactgctcagggcaaacctgcctcatagtcatccctctgcttgtattcatagtcatccctctgctcactgagataaatgcatatctgattacctgctttggaaaggctaatcagaaactcaaaagaatgcactgtttgtctctcacctgcctgtgacccggaaaccccctccctgctttgagttgtcccacctttccagacggaaccagcatgactccctaaaatgcagaaaaccaaactgtgctctgaccaccttgggcatatgtcatcaggacctcctaagtctgtgtcatgggcgtgtgtcctcaaccttgacaaattaaactttctaaattaactgggacctgtctcaaattttctgggttcatatttggtaaccatggggggattctgagtggaggtgcccctgagctttgacaaatcttgtattgatgcttggtacatcatgaactaatttattgctcaaatcaataggacaatttgctgaggtctgcgagctgcccctccagagaatccctgctctcccaaaatttggtcaagatctcaagtttattttggtgtacaactcctttattttggagttttactttcttccaacaaggaagggaagttttcctgcttccgtgataatggaaggcaggtaactcctttatggagtttgagctcacttccaacagcgaagatgagatttttcctgcttctaggatggtggagagcagtcttcagcctgagacccatccctgggtaagtaactgaattggggtttgtcttggctaaagttaaagttaacaaccagctggtcttaatttctttttaccattagagtgttcagtgatcatgtaagttgtgccattgtttgttttgcttaagggttttttttttttttttggtgtttgtttgtttctgtttttcctactgtttctcttgttgtttcagtcttttgcccattgggtttaatcaactctatccaacttgatcaactctgaagggaagttccaaattatggggaacaaggcctctgaagtgactaaattccaccccccgcctcccctccacacacacacacaaaaggtggtatggttgggggagaaaaacagccagcaaaaggagaaaaaaaggaaagatttttgattttgactactaaaggggttttatttacagaacaaggccacttttttgctagcaggccaaactgaaacaatggcagttgccccacgctgtagttccatacctaaggctctgctttcttttcaccatgagagcctgggtttggtgggtttggttcctaaatcaagccctttctggtttgatacttggtacctctgaaatagcagcaattttttctgactaaaatacggtaatgaaatttaaatggattattttaaaaagagctcaatggttaaaagtcagtttaattaaaaggctaacatccaagatgtacgtgtgtgtgtgtgtgtgtgtgtgcgtgcacgcatatgtgtatgtttgtctttgaaaggtcttcatgtgtttgttttttggttgtttttctcctctaggaccttgccttttttttttagcaaaagtttttttcttctcagttgactgaattctgttattacctgattgtttgactaaaatagatactgcacagaggctactctggggtttttaaggaagagtgtagtttagacacttaaaaatgtctttgtttaaaactattttttaagtgcactgtaaaagcatcacgttgtctagcctcataataattcaccctttttggagacccaggattcagtgtgggctctacccagagctcagatatctggttaaaaaaagaaaaacaggtagtctctatctaaataaaatcagtcttcctatgtaatccaacaataaatttctgtaattttattactgagttggcatccatctttaatctttctctagcaccaccagacattttctctgtgtacctgataatgtaaattttgctatttgactttcacctgatatgcagatttaaggctatttagctgacaactgtctagggttctgaaacaggttatcaagaatctgaaagtctaagatatgaaaaaagaggtttttatgaatctataagatgtacttttatcagcatgcctaatatgtctgtatttatgtgttgtgtacacaatgtttcactatgaaaaatatataaaagagctctaattaattggctcaaagtgaaataattcaaaaagcagctatattcattaaatcaatatcaatgatttatacttaatacgtaaatactttatcaggaaaaaaggaaagattagtcaaatgctttttcaagtttgcataacttaagtaaaattattaataaatgagctcgctttaaaattattggtaaagtaatattagaaatgtcagcatacatttttgtttgcaattattaatcaagcaatttcatacttacccctgccaaatagtataagttgtcaaaatttggcagagggtttacaaaactataaacccggcccaaaacataatgatatttgcttgtgtaatctttaataaataagtcattgatattgatttaatgaatatagttgcattttgaatttagtaagattatcataacttctaattctgtggctttaggcagtctagtgcacaggcagtaaggaagtttgttttgagaaaggactgttatagtgtttgtttcaaagctaaactataaactaagttcctcccaaagtccaggaatgaacaaggacagcctggaggttagaagcaagttggagttagttagtcaaatcttttttccctatctcagttataattttgcagtgatggtttcataactttaaatcatgactatcacagttttcataaacaatctaggtaaacaaggtaattaggtaaatgtaatgtgatacatacttgtagacaaatttgtcataatttagaatagaaagttatattaa

SEQ ID NO: 700 - DNA, 1799 bp, Homo sapiens
cttctcgctgcctccacctcctactccattcaatgcatcttccacagcgcctcctgagtttgtttcctaaaagagcaacctcaagactcagctgctctgcctgaagaactctgctgcctccagcagaaagctccacctttggaaacagatatgatcctccagcaatcccaacactcggaggctgaggcgagaggatcacttgagctcaggagttcaagtccagcctgggcaacacagcaagacctccagtgaaattcaaaaaaattagccaggcgtggtggctgtaagaattaaagaaagaggagagaaacatgaagggtggtttgacagtcatcagggacaggtttattttgaataataaacttggcagctggccgaaatgcatgaggctagaaagggagctgtaacttaaaggggcggtgtttgtcccagatgacagtgctcttgctccgtcagtgtcatatggttgtagtcccagcaccttgggacgctgaggcaggaggatcgcttaagcccaggagcttgaggctgcagtgaactgtgattatatcactgcactccagcctgggcgacagagcaagatcttatctcaaaattaatgtattattatcattattaattttttgagacagagtcttgctctgtcacccaggctggagtgcagtggcagaatctctgctcactgcaaccttcgcctattgggtcctttgctgctatgattccagggctggaagggtccttaaagatattccagccaacgccctgggtgatgctagaattccttctagactttaggcttgatccacacactcccagaactagtaaagctctcagagacctggggacctggtatgcagggcccactcctgccttctctgggggaattttccccaccgcctcctttctttgcctggtccaagtcccagcttccagaaagaggtccatacctgagatacctccacttcctcctcctccagagccagcttaaagtcaggaggcggcacaagtccgcgaagctcagaaagtcccccagattcctctgtggtcaagccagtttcattcaattgaagcttgttccctgaggatttgttcatgggggagttattgtgtacttgattatagttcccatggctactggctcacagtgtgaagggaatgggcatacatccacgtcctcctgcaaaattgggatttgacctcatttataaccaaacatgcagcaggcaaccttgcaaattacacagcatgaagagagtccagagagttctgaatgacttagtagaaaataacattaaataaaatagtacatgcggaaggatgtgttctctccctggttcaacttaggtgcataatagctgttcatagcagtattaaccttgacatccaggagggagaccattcaactgaaaggttgcaaactggcaaccctcagtgggaatctcacccatagacctatatatccaatttcagagtactatggtttgaatgagtccctcaaatctcaggtgttggaaagttaatccctgatgtaatactgttgagaggtgagatccttaagaggcaattaggtcaatggattaatgccattatttcaggaatgggtttgttataaaagcaaattcagccccctctttctctctctcatgctctcttgccacgtgatgatgtctcaccagaggcagctcctgtatcttggacttcacagcctctagaaccataagccaaataaatgtctattgttcctaaactacgcagactgtgatattctgtgatagcaacatgaagtggacacagagtgt

SEQ ID NO: 701 - DNA, 2732 bp, Homo sapiens
ggcacacatacccctgtgaatgccagaggcaaagaagagcctcaagccacaggctatagctgacctggcaccctgggcacagcaggcagattcaggggaggtacagccatactgagatagaggcagggctgggccctggtttctccactccacagagaatgtgcattgtaggcttcatggaaacagagactgtatgttatccacttccgtactttcagcatccagcacagggcctggcacagaataaatgctttggggcgcctgacactgatcacactacccctgccctcctgaggctccacatctatgtatcccatggaaaccagagtcacaaatggagacagattcagagactcagcctgaaaggagacagaagaggccgagagctacaggttgcatggcccaggatggcaaagactccacggttaatatcacagcagctggacagagacaagagcagagtcaggcatcctgggctggcagctgcctgttgggactacacagccccaagccagctccctgtctccctaggcagaacacacgttggcagagacacttgctttctcctctggctgtttcaagcactggcctaagaggtggggacttgggaggaagagaactgacattgcggagcccaaggaagcgaccagaggaagctaagtccccggaggaagtcatgaggaccacactttccagctcccccatcctcttctttcagccccaaatcccacgatccactggaaacatgagcacttggattgctggaaggcccattaacattcagctcatacaaaactggctttgcagccaggtgcggtggctcacacctgtaatcccaacactttgggaagctgaggcaggcggatcacctgaggttaggcattcaagaccagccaggccaacaatgcgaaaccctgtctctaccaaaaatacaaaaaaaaattagccaggtgtggtggcgtgcacatgtaatcccagctacttgggaggctgaggcagaagaatcacttgaacccaggaggcagaggttgcagtgagccgagatggcaccactgcactctagcttgtcagagtgagactctgtctcaaaaaaacaaaacaaaattggctttgcagacaggacactgggccccagagtccacccatcctccaaggcccagaccaaactcccccatctccatgacacattttccaagtcctcggggcctgtaacccatagttagcaatcagatgcctcctgtcacgcattgtctaataactgctttgaacatttccaacttggaaatcaagtccctggaggaagagccccaggtcacggtgctgaatgcaccctacagcgggtcctccaggattctggctggcaagccccagccctttccctcctccctcccatcctcaatcccacactgctccctgcttgcctgtgtcctgaaagcccaggcctcgatgtttcccatttgtagcctcagcattcgccacaccatccttctgaggaccaagaaagaaaacctgagcctctggccccggcttcccaccccaaccctgtcatctggtggggtcaacaggacaagttttcctaacccagcaggggagggaatttatgtcagtcccagtggttctaccatcccttggccaaccaggcaagagtgacccatgccccagtaagaaatctggatgcatcagcgtgggctgacttaggagctcatggagttgcccctcaaaggaatctccttttctcctgcctttttcatctttggtaggcggccctgctgcctcccagcaggtgaccacatggccaagaggctgctccccctctgaaggtctcaccttacccttctgggactccaggaacatctaaaagggaacccaaactgctgtagtcatcaagcccctgaggactgtcccaactggggttccccctaagctggatcctaacactagggggctcaaaactgcttgctgtcagcctccagctcccaagaggagtccctgagggaagacatgccttcctgcggccagtcttgcggggtcgtggcttgctcttggtgaagcagatgttgtgcttggtggacttaaaggactccagccgccgcttcatgttctgctggaagacctccttgtcctgccgctcctgcgcatcctctgagatgaagtggcgactgcagctggctttgtactggcaatgacagccccgcctggctatgaggatggatgccttggcctcccacaagaaccccaggccacagccccaacatattcaccacaggacctgccagcccagcttttccagaattaacaatggattgaaaaacaaaacaaaaaatacaacaggaacccagccagagaccctgtgttctcagttccctgggaaaagcttccctttatcccagaacttattcccccaaacctggccttccccaacccttgccatcctttcccgattctctctggtttgaaggtgaccctctgtcttgttctactactgtgacaacatgggggacattttctttgtacctccatttatctgagcttcgcccacacacccagcctacctgcccccttctagctacacaggatcctttctccagctggaatctcctatctagccatttctacaagaaccaccatgatatcctgggctgcactttgaactttcataactatctcccctgacaccctggaccttctcagtcccaataattcaggatcacccccatcatctgctttttttt

SEQ ID NO: 702 - DNA, 4361 bp, Homo sapiens
tgtgctcagtgccaaaatatctgatcaaaaaataaccaaaataagcaaacaccaagacgactgttctggggactatggtcagggagagccgatggctcagatccaggaaaccctaggctccagggtacctgtttcactacccctctcccccagggaagctttgctgaacgttctgataacctagaaggcccctttccaaggaatcccccacagcacaatctcccaggactctgagatttccaatagttcctgtccaaggggcagctttgcctgaggtgggagcatcgggagagggtgagggctggggatcacttcccaggagctggcagatgaagcttctaagaagctccctccctgccctagccacaagcatccgcactcactcattcacccacccctcttctggcccttcttgccttaggcttatctccctttctgtgcacccaacccccactaggccacttttgttttctcatagcccaacgttctgatgggatgaacagaggggaggaagctgacagtctccagccccctaccaactcctcagtggaggtgccagagaggggtaccataaaagtagctgacattccgaggcctctgcccacctctagctcaccttcctaggggagattcctgaacatccctgaccactcacaccgcactccaattttccctcccacttcttgggagccttctagttccctggagacctcctctcaagtgggcatgtccccaggaggggtaaaaggatagagcctcacataagttagaaatgggcagagctcttggtactacctgtctcttttccttcttcatccaccactttcccctctgaggaggcttgtctagatgtctggagcactgggaattgggggaatgaggaggagcccctcaactctgtctcagtcacatcacttaatcacacctctccttctgccccacccctctggcagtgaaggctcactcccaacagatctccacccgcttccgggaatggccagaactcgcctcctgcgtctctctttccatttctatcttcccctccccccaagagctgtagtggccttggcctcctggcagtgccttcccagcctgtttccatagaaactgggtaggctgtgcagtgcaagaatcggaggggagacaggagcaggaaggagggaccaagccttagggacagcccccgatgaaaggaccgagagaaacggggagctgccccatgcaaactgagggtgggaccccgatttggggaaccaggcgggatggagcgtggagtggggggaagaggtagcaaaagcttggtagctggctttgctgcctcctgaggaaggggcacagaatctccccttccctgccacaggtagtgggggttcctccctccccacccccttaaaatccttctttaccaggaactgcctgatccagatgaatctcttctccggggcccactagtctctaagaaagggaccatggaattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtctgccgcggcgcgggggcagcctcaccccacctcactgctggactccggagaaccatttctgggaccgggagctgtccagcgcctcgggtcctgacggaccgctgattcgcctaggtgccatcggacaagcgggtgctcagagccagctctggtggctcgggagctttcccccaaccaggctaagaccactaaaccacgcctggcccggatgagcttggatgcagctccgaacgtggggatccatcggtgctgagaactgacctagggagcaccttgacccctgccctatctgggcacaattgaagggccaagtgccaccagcccactttcctggaaccctgtctcagacttgggcaggaagaagagccatgagaggtcaggccttgcctctccccgcgttccccatctttctctgtgcctctgtttctgttttcctccggctctcctccctcctcctctctttccttccctgctgggttgggggctgctgaattatcatttctcagctctgctaatgtgctccccgctgcgggaagggatcataattctgggagatgattaagtttcaaattgtttttctttgtgttgttgaagatgaggctttaatatggtccttcctcagcccgggagcctgcccccattcctccactcctagtactctcctcactaataggctaggtttggtaccatgtcttttgtggtccttgccaaacttttatgtgtatggggtggtaaacgagaggggtatagacctaccctttactcaaaggggaatttttttgtttttgtttttttttgttttttttgagaccgagcctcactctgtcgcccagattggagtgcagtggcgccatctcagctcactgcaacctctgcctcccgggttcaagtgattctcctgccttagcctcccgagtagctgggattagagctgcgcgcctccacgcctggctatttttttatatttcactagagacaggtttcaccatgttggccaggctggtctcgaactcctgacctcaaatagtctgctcgcttcagcatcccaaagtgctgggattacaggcatgagccactgtgcctggctaggaatacatttaatatagtggtgagaaacactggtttggaagtcggacaagtcaacatttaaatcctgactctgccacttactactcaggtgaccttggatgagttacttgaactgtctgagcctccgtttcttcatctactaaatggggatactgtgaattacctcatggagtgttggtgaggatttaaagtgataaatcatgtaaagtggttagccgggtgtacagcttatggtaaaactcagtgaatgttagtagatattactacccacataccttaccctgtttgatcctgcttcccatagccttcctgactttgttcttctgttcaatgtttatctaatgcctactgttttccaggtactgtacaatagagagtaagttatccaggagtgaggaagttggctttcttacctatttgttcctcaaacaccccttcctttacctccttccttccttcctttcaactgaagtttactctcattttaccctcccaccggcttccagttcttcctgcattgttcctactccatttttccttctttcactgatgtcttatcacttcactttgattcttatcctcctaatacacatacattttttcaccttctacattattcttcatcccatttggggccatcatagtgaaaaaaagggctgaattttcaaactaggaaagagaattctgtcatgctgtgtgtatgtgtatatgtgtgtgtgtgtgtctgaggaacacacacattaattcacattcaacagtaactctatagctgacttctgaactcctacgtttgaactgtgtgcttgtttgcctctctatcccctctatttaagctcttaaaatacaagtctatttctttgcctgcctacctgtctgctctgtccttgcctctctctcttttggaatttgttgttttaaacatctttattgagatacaactgatatacaaagaactacatgtatttaatatgtatgatttgatgaatttggatgtctttgttatattctaaatgggaatgcttactggttgttagtatgagaagctgatttatgataatgtgtttttgtgtttgcttaactggcctcctacctatcaccatactggtgatgggttcaggatacactacaccaaaatgtggcaacttgacatttgagaaaacagcagaagcaggaaggtccctctcccttcttcctggaagtgggccaaaaacctctgaccgtcttcctccttttctcctgaggtagaacataaaaccctaattccagaggtatcctccccatacccagaggaaaggagcatccttgtcctcaagttacacagagttactaagtagaatttgaacaaagagaccttgctaagttttctccagttcactaccactagactatacctcctttgtccagtcatacttctgcttgcctgtccactcttaataagaatcccagtctggcc

SEQ ID NO: 703 - DNA, 2494 bp, Homo sapiens
tcagcaaactaggaatagagaacttcctcaacctgctaaaaaaaaaaaaaacaacacacaaaatctctgatttaatgggagaggctaggagctttccccataagattgcgaacaagacaaggaaatccccactcatcactcttcttcagtatcatactggaagtcttagctaatgcagtaagacaagaaaataagaggcatagaaatttgaagggaaggaataaaactgtttttgttcatagatgacatgattatctatgtagaaaatcccaaagaataaaaatagcccctcctagaaccaataagcatttatgacaaggttgcaggatataaggttagtgtatataaaaagctagttgcattcctctgcagcagccctgaactactggagtatgaagttaaaaatgcccgcacacaattgtatggttaaaatgataaacttcatgttccatgtgttttacaattttaaaaatccattagaatctcagcaagtttgattttagttgatatctattttgtggatatcaataaactgattttcaaggttatataggaaggccaaagacctagaaaagtcaaacaatattgtcaggactgacactacctgacgttaagacctcctctaaagttacagtaataaaaaagcaaaagcaattcaaggaaaaaaggatattcttttcaacaaacaaatggcactggaacaactggacactaatatgcaaaaatattaatctgtacaatgactttacaaatttaataaaaattaacttaaaatgaatcacaggcctaaatataaaatgccaaaccataaaacttctacaagataccacaggagacaatccaggtgccttgggtttggcaatgagtttttaaacacaacaccaaaagcatgatccatgacagaaaaaaatgagttgggctttattgaaatttagaacttctgtcctgtgaaaaatactgtgaagagaatgaaaagtcaatccacaggctgggagaaaatatttctaaaactcatctctgataaaggacttgtatccaaaacaaacaactcttaaaatgcaataagagaacaaacaacccaaataaaaaaaatgggcaaaagatctggaaacttcaccaaagaagatcaacagatggcagggccaggtgcggtggctcacgcctataatcccagcactttgggaggccgaggcaggcggatcacgaggtcaggagttccgagaccagcctgaccaacatggtgaaaccccgtctctactaaaaatacaaaaaattagccaggcgtgctggtgggcacctgtaatcccagctactcaggaggctgaggcagaagaatcgcttgaacccaggaggtggaggttgtggtgagcagagatcgtgccattgcattccacctggatgacagagcaagactctgtctcaaaaaacaaaaacaaaaaccaaccagatggcaaaaagcacataagatgatgctcagtatcatgtcattagagaactgcaagttaaaacagtaagatatcactacacacctgcaagaatggataaaacccaagaaactgaccagcaaatgatgatgaggatgtggagcaaaaggaactctcattgatggctggcagaatgtaaaatagtacacagccacttgggaagatgttctggtagctttttacaaacctaaacctagtcttaacttacccaactgagatgaaatgttatgtccacataaaacctacacaagagcatgtaaagcagcttcattcatgatgccaaaagttggaagcaacccagatgtccttcaatacatgaatggataatctaactctgatacatccatacaatggactattattcaccaaaaccacaaaggagctattaagttataaaaaggcatggagaaaccttaagtgcatactgctaagggagagaaggccatctgaaaaaaagcaaatactgtatgattctggctatgtgacatgccagaaaagccgaggatctagcaatagttgagagaagtggttgtcagggttttggggagagtagaggagggatttttagggcagtgaagctctttggcatgatattgtaatggtggatacatgtcattatgcatttgtccaaatccgtggaactgtataacaaaaagagtggatctttgttttttgcggtttgaagacagggtctcactcccctcacccaggctatagtgcagtggtgtgatcatggcttcctgcagtctcaacttcctgggctcaggtgattctcccactacagcacgaaaaatattaggtttggttttaagaatgaatctactaaaggaaaagataaaagctggcaaatcctgacaagctctgttatttcagagcacaaactacctgccatgactgttctactacaacagcttttcataatcacacttgaaaagtaataccagtttttggtcaaccttccttttttggtgtagtgctacgcatttgccctaatttcatgtgttttaaag

SEQ ID NO: 704 - DNA, 11683 bp, Homo sapiens
gtcccctgcctgaatccgaacatgctggctcctgatcctggatttccagcctccggaactgtgagaaatcaatgtcagttgttgagaagcacccagtttatggtgttttgagacagctgactggactaaggcagaacgaaagaggggaagactcacttgtttcttcacaggattaaacaggtgagcaggtggatggaaagaagggggaggagggaaaagggggaaggggagacggacaggtcaaaggagaggagaaaaatggactttctttttacataattttctgtatttctgctttctgtaataaggttgagctgcttttgcaataatagtattacaatttatgtaaagcactacataaaaatattaaacaaatcttccactgtgctcgtcacaaaagcattagttaaagatctaactagggaggccaggtgcagcggctcacgctcctgacctcaagtgatctgcctgcctcggcctcccaaagtgctgggattacagccgtgagccaccaagcccagctcccccactcttgtattttaatgagcagttagcaggtgttccacccgagggggcctcacccaggtgccagagggagcacaaggcctaggtttgtgcaggcaccggctgcagactggccacagggctctcccatcctaggcccctctgggacatgctgggcaccccccgaaggttagcctgccatgaatggcccagtgagctgggttttggagttcatttttaaggagctgtttatactcggtgagacaggagcagcctgacatgcgcccagaacctcctgcccttggccccacaccgccctccccactctctctgccctctccacactgtgctggtcccgctgcccactcctcagagactcacccccggctgccttttggtgtctggccaggtgcattagaggtccacccttcaggatgcacccctctacccactacgccatgtgctgaccccaaaatcctggggtgcagagccagagagtggtgaagacacgctggcagcccagatgtgtgcagccccagagctcttcccgtccccccgcatgcgcgtggatagcatggctgggacagatgctggcctccagccccacggtgtgaggctctctcagaatacctgggtcctggggaggcctcagccaccattgcctgtgggactggccaagccgctcagcctctcttaagcctgcactcacctacagataatgatccctgccgggtgatcatgaggggatggcaaaagagaaagtgcctggtaaatgtgtgtgtaaaagactggtatagcagcccagtgtgtgccaggctcctaacccaggcagccttagacaggggaggccaggctctgagagcagatgaaactagggttcagagattccacctgggagcagggtcaagctgccctctggtgccccatgttcgctgccgggtcagagacacgccaccttccccctcgaaagcgcttcctcccgcagggcaaatgcttccgcagccccagtggtcatgctaccctgcagccactgtagcccctcaggcctcctcctttttacttttttaaaaaattgtatgatttttaaattttttgtagagacagggtcttgttatattgtccagactactcttgaactcctgggctcaattgatccttcagccttggcctcccaaagtgctgggattacaagcgttaagtcaccacgcccagcccaggactcctcctgagccaagaggctggggcctccaggtaccagtagggccggaggcctcaggaagcccctggtaaaggagctcccagagcaaacaaggtgaccagcgtgcagcacacaggcggggagtggggctgtggggtagcccctggggaggctgcacagaggagctgtttcccgctgccccttcccaatgccagagcccatcagggccgacactgctgctgcctgtgggcaggacaaggtgaggggcacttcctgaggaagaggggcttagaggccctctccccgaaccctgggccagcctctggggctgccatctcacagacccttgatgtgggggcatgggcttcagcgtgactccctggcaggtgccacgtgctcaatgagctgatctaggtgctgaaagggagatagcaaggcgggcctgagccctagcttgaggacttctggggcatggcttggggcagataacacaggcaactttggcaaaagtaaagagagacttcctggacatgggggctgttgctctgtactagaatgggctgccaggtgatgtgttccagtcgggtggcactgattctcaaggagaatcgcttgaacccaggaggtggaggctgcagtgagctgagattgcaccattgcactctagtctgggtgacagagtgagactgtctcaaaaaacaaacaggccagactcggcggctcatgcctgtaatcccagcactttgggaggctgaggtgggcggatcacctgaggttggaagttcaagaccagcctgaccaacagggtgaaaccccgtctctactaaaaatacaaaattagctgggcatggtggcacatgcctgtaatcccagctactcgggaggctgaggcaggagaatcgcttgaacccgggaggcggagattgtggtgagccaagattgcgccattgcactccagcctgggcaacaaaagcaaaactccatctcaaaaacaaacaaacaaaaattgcaaaaatagtacacagtaccacgtaccctccacgcagttccccctaatgttaacgtctcgcgtacgtaaccgtggtgcatttgtcaaaactatgagattaacattgattcaatactatcaccaactgcagactttcggtggatttcaccagttttccactaatgcacttttactatttccggatccagtccagggcgaccggggtgcatttagccatcgtgcctcctccgatgtgagatggtttctcagttctttctcggttttcatgaccttggcccttttgaaaagcagtgacgaggcattttgtgggtgttcctccatttgggtttgtcagatgtttttttcatgattaaactggagttctgcatttttggaaagaataacatggcgatgaagggcccttcccatcatgtcatatcaggagtaggtaatttcaacacaatttatcactggtgatattaaccttgtttcttgattgaaatgatgactgcaaggtttctccacggcaaagctgctatctccctttccatactttatttgttagaaatgtgtcactaagtccagcccacactcaaggggaggaaaattaagctccatttcgtggaggggagttctctccatatattatttgcaattcttctgtacagaactgtacctttgcttccatttgcttatttacaatgcattttcgttatctcctgtcccctccctctaagctgagtggctaggtgagcccctcccctggggcatgtgctaagggagagctccatccctgtgctttctccttgcatttcgtgaactataccataatcattactttccttgtgagcttccttaccaagggacagtttttaaaaagtcatttatttagtagtcatcggcaggcacctttgtcaagtatttttctgagcatgatctcattttactcccatgatgtcctgtggttatagtttccatccccattttacagatgagaaaacaggctcagagaggttaagctactggcccaaggtcacacaggaactgtgtcacacccctctctccccagtgcccagcccagtggctggcagcatatccggctccaacaggaacttgcttactgaagagcagcccacacgtgaatgggcataaaaaagcaaaacagcaaactcccaggtggttgtccatcactgcctctgggagttgagcctatagtcagggagttcagtgagttcagtccagggtcttgccccctcctgccatggcccaacaccatcaaacagtaagaggggtccttcttgtagtagagcgacagctcccactttttctttttctttttttcttttttattttttttaagatggagtctcactctgttgtccaggctggagtgcagtggcgtgatctcggctcactgcagcctccacctcctgggttcaagcgattctcccacctcagccttccaagtagctaggattacaagtgcacactaccacacctggctaattttacccactttttcaagttcccacacagcagtggtaaactggggagaggacagctagggttagtgaaaggaatgacgattccgtccaaactgtgagtgccagatgattgcagacaggcagactgtgcttctctcagctccccatgccatgcagagtgacccagagtgacccaacgagacccagcatggatctatgagtgacactgagccaggaaggtgtccagggaggggctgcagaccaacctgggcacgaggcctctttctaagcccaccctggttaagtgctttgccagtttctaggtgaggatcagcctcagcctgcactgggcctactcagtaaaggtttccacggtctttggatttggagcccccaatttagggcagagacaagtataaactgaccaagcaatagaagagatgcccacatgaggactcctgggaggggcactgactgcagcctgggtggcggctcctgggcagagggggagctgctgtggctacggaacaggccagcaggaggagccagtggtgatgagtgccctggtgccaggaaagcccctggcagagggcctggcctgtctgggggaggctggtgactcctggttccaatgtgctcagctctgagccagaggccagcctgcctcagacggggcatttccttcaagtggttaaaattcgtttttgtgctgagtcaggaagctagccggcttgggcctccccacctccaacgctgagtggcacacagtaccagtcatcagcctaagcagagacctgggtaagtgccccctggctctgcccaggggacaggaatgacagcagcatcccaacagattcctgctcaggccccgcagggatccacaccaagtcaccctgtgagatgtttctccactggtcactctgtcagtgccttgagctcctggcctggctggccctgctgccctgtctgcgctggtgccagcactatgctgggtcactggggaagtcgggctggcaacatacccagatgcaagcagttggctgagcagatgggctgggtagccacgaggacccttggaagcctgccctcccaggccagtcggcggtttgttctgttgcccagagacatgctggcctcctgaggctttcttctggggctgctcctggggcactctgtccaagaggtggcagggtggcactgcagtgtggttcggggtgggactcagcgtgagtctggaggcagggcatccagtcattcctctgcccacactttgagtaactaggacaggctgcttctgttctctgtgtctccatttccctttctgtaagatgcagagattggactaaatcagtggttctcactgccgcgattcctggaccagtggtgtcaacaacatctgggaacttattagacatgcatatttggccaggagcagtggctcacgcctgtaatctcagcacttagggaagccgaggccagcagatcacctgaggtcaggagttcgagaccagcctggccaacacggcgaactcctgtctctactaaaaatacaaaaattagccgggcatggtggtgggcatttgtaatctcagctactcgggaggctgaggcgagaaaattgcttgagtccaggcagtggaggttgcagtgaactgagatgatgccattgcattccagcttgggtaacagagcaagactccgtctcaaaaaaaaaaaaaaaaagacatgcagattcacagaccccaggaagacctgctcagtcagcagccagtgggtaggcccggcaatccgtgttttaacgcgccttctgggctcatgctggagaaccactggcctggacaaaggcctaagcgtcttcctaggcttatttcaattcactgggcacccaccgcataggaggggcttgtgccaagagctggagaatgcaaaggcggacgaggtatgaagctggtaccaaaagggcacctctgtttcctgggtggctacctcctagctgtccttaacacccagctcaaatgatgtcttctttgggcactgtcccagaccagccctcccaccagttcctcagacacgagtaatcgggtcccacctcttcccccgacgcctgtgccagcacggctcttggtatataggatgtaccattgtttgtgagtcagtttcctgctgaacagtagggatgggaagggccgagggtggctcctgttcctccacggtcccacagccctgagcaccaaggggtcccattccccaacatagactgtactagcccagcctctgcaaggcccctgccaagtgcccatgtcctcaaagaagctttcagggcccactacacccatagccccattctggggctttcctttggcaaaagttgcagattgggccatgtggcccccctactctgagcctaaaagcctaagccaacctggttctccctcttgggaggtttgaagacgtatcacacagtgaggttgtagcgcagcctggagacacagaaagaaggccgagtgcagccactgaggcagccagaaccacgtggcaggaggtgtgtccagtgtggggaggggtatggcagccacagcaggaacaaactgcactggcctcctcaccctccctggagtgatgggactgagcacccccttttgtgcctggtgggagctgcccacagcccccgactctgggccagcttacaaggactcagcacgtgctcttagcagcctcttttccaggggcaggcagctgggacaaagcagcactggacccgagctggagggatggatcccgggccctccactcactggccgacaatgacgggcaagtggcttcacctctcgtccctcagtgacttcatctataaatggggctgaaatcagggaatcaaaaggcatgaagagctagcccctagcatgacacttggcctacttttggtatttaataaacgtcttctgacctggtcctccttcgtacctcaaccacatcagacacagcgtcatgatgatttttcccctgagcaaagtggctttgtgtgaagttgctaggcctgagtttccccatctaaaatacgcaggttgacctggatgatctgtgcctcagctacacctacagacctctctgctcaccatcatgagtgcccctagcaaagggagacaggggccctggggtgttgggaggaatggacactcaatttccagtcaggcattgaacaggtcagtggattagtgggtctgtgattcattcatccatccattttgtcaaccatttgttagatcatttgtcaaccagccagccagcccagtggctggtcagctcacagcatattctggtccttgtactgcttccagcccagtaaactcaaccaaagagaaagagaacagaagaatgagaataaacaaactccaactgcccacaacaacacactgagtgaaagaagccagaccccaaactgaacatactgtatgattttctttgtattataaaagtgtcacacacacacaaaaagtgtcagtacatccaaaaccaaccgaaagtgtcagaagccatgataaggattatcctatgcaggggatcagggaaacggtaagtagtgactggacggcagctcatggggcttttgggattctggtaatattctgtttctaaatctgggtgctggtgacacagtgtttgcctagcgaaaattcattgaattgtacatttaagtttttacactttcctgtatctacgctatgctatagttcaataaaaatttacccaaaaaaataataaaagaaagaaaagaaaagcaagaaaaagcaaggaaatgcacagagcagttaactcagcaattccagttctaagagctgcttatcctgtagttatccttccaggtgggcaaatgatggaggggcatgatgttcctggaaaactggaaacctaaaagtcttggttattcaaccagaatgttaaataaacaacacatccatatgatggaatattacttaaccattacaaagtatgatcgttatgtaccaattgcaataagcccttagactgaaaagtcagtaagtgagcccaggaggtatacagcactaccctctgtagcagcaagcgtgcatagccacaggctctctctggaacgacacaggagaaagtggtggcattctggcctgcaggctcacgctctccccttaggggatgttatctgtggccacatccagtctgcctgccagaccatgctcttcccgagggtctacggagcctggtgccagtagtcttagttcagtctccaagtgaatgattcgcaatagtctgtagcttacaaattgccatccctctgactgcgggcagggccagattcaggggtttggcgacgaccacagactgtctgtccatctggaagatgggctagatgtgcgcagaacaggggctcatggctgaagagggcacagttcccacatgcgcctgctgtccaaggagcagaaacagaccctggggcaagagaagccagagtgccagttcagggagagctgctgccgccttctgtcctgcaggaaagaagacttggcaaggtcacaccggcaaaacaaggatttgtatgcaggtctgactccaaagcccgggcatgctgccttctgcagaggccaatcagggagggcttcactggggagtcatatgcagtctttttttctttttttttttcttttttgagacggagtttcactcttgtagcccaggctggagtgcaatggcatgacctcggctcactgcaacctctgcttcctgggttcaagcgattctcctgcctcagcctcccgagtagctaggattactggctgattttttgtatttttagtagagacggggtttcaccatgctggccaggctggcctcaaactcctgacctcaggtgatctgtctgcctcggcctcttgaagtgctgggattacaggcgtgagccaccgcgcccggcggtctcatgcagttttgcaaagtcaaagcagacgagggttggcatgttccacgcagaaggaatgctgtctagaaacagaagagagtggcgtgaccttgagagtacagggttctgtattgggtcagtgggggcaggaaggcagcagggaaagcaatttgggaaactggtcagaaatgatgcaggaagtgctggctggagcctggctacaaagactcatgggttcctggccatggagcctgaagtcagtcctataactgtttggattccaactgacggcttgaatacaggttcagctccacctctgcttccagaagatcattctggcagtgaggtgagggcagattgtagggcgtctggctggagggagggagacctgttgggaggcagtggcaacaattcaggtgagcaggtggtggccaggacaagggctggcgtgggtgacataagagtttgagaggaactgagaaggaagaagggcatgtaattggcggaagacagcaactgtgcgaaagggaggaggtaaaggtgacgctcaggtttctagatcaaggaacagggtctccagttgtacccttcacggaggtgagaaatccagatttggctggaatccgagttcagttttttgtttgtttttttgagactgagtctctgacgcccaggctggagtgcagtggtgcgatctcggctcactgcaatctctgcctcctgggttcaagcgattctcctgccttagtctcctgagtagctgggattacaggcgcctgccaccgtgccaggctaatttttgtatttttagaagagacggggtttcatcatgttggccgggctggtcttcaactcctgacctcaggtgatccgcccgcctcggcctcccaaagtgctgggattacaggcgtgagccaccgcgcccggccctgagttcagtttttttaaggacacaattagaggtgctcacgggatgttcaagcagggaggctggtggataccttcgattcgctcgttcacctacgtggacttattaaacagccaggctccctggccttgggagagtccttctggtggggagacagatgataaataactgaagtaatggaaaaggggcagttcaagaaaagtgttgtggaggaagaaaacaagaaagcccgccagaaggggactggaggtcggccccgagggtgtgtccgctagagggggcctctccaggtggactgcgggtgagagtaaagggggcatgtgggggaaaagcattctagggaacagcaagtgcgaggacctggagacggcagaggggctggtgggacaggcgcccaagaggaggcccaggctgtccctccggggcgtggggagaggcatggggctgggtccctgcaggagctcacaagccacagtggggagcagaagcgttacgctgagtacagtgggagccactgaaagggttaaagacccctgggggtgctgagtgggaagaggctctgggagctggagtggacgcagggagaccagttataaggcgaatgcaggagtccaggcaaaagagaatattccagtgtgtatcttaagacttaactttttacacacagaacaccctgcgcccctctcagagcctccggggtcttcatgcgagcagtttatcacggttctttcgtcttaaaccctcttactatttcagcaaacaccctctcctcagcctggtcaacccctctgcccaacccgagtgggccccgaaggaacaagtggggaccagagtcctgctcatgtgagtggtggggcccagcccgttcccctaagaccagaattctctcgctcagagcaaagccccggggtgccgggattctctctctgctcccgctccctggatggagcttttaaaaaaggaggattcctcactgcggcctctgccccttgcactgagcgccaacccgcatcacagctcagcaaaggcgcgcgcagtgaacagacggaggaggggtggctcctcgctgagctgaaggctgcggcgacgaaaataaacagcatggttcctgctctccacgaacctggcgctgcagacgtgggcaaaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaaggacgcattcctaagagacgaagggagaatgacagaagttaaaaacaaccaaacaaaagccaggttgaggcctctaggtgggtctccgctaccgatggattcagccggtggggctgcaggaggttcctataagcgtggtcccctctccccgcaccgagtccggccc

SEQ ID NO: 705 - DNA, 1397 bp, Homo sapiens
ggctgaggcgtgagaatcgcttaacctgggaggtggaggttgcagtgagctgagatggtgccactgccctccagcctgggcaacagagtgagactctgtatcaaaaaaaaaaaaaaattttttttaactgtaaaacggcctcaggcaggtccttcaagactaatgctttaggcctccacgttcactcacccacccacagcaacttcccaccctgcaagctccattcataattcatgccctgtataggtgggctgtactttttttttttttttttttttttgagatggagtctcgttctgtcccccaggctggactgcagtggtgagatctcggctcactgcaacctccgcctcccaggttcaagcgattctcctccctcagccccctgagtagctcggattacaggcgtgtgtcaccacacctggctaattttttgtatttttagtagagatggggtttcaccatgttggccaggctggtctcgtactcttgacctcaggtgatccacctgcctcagcctcccaaagtgctgggattataggagtgagccactgtgcctggcccagaattcttacaacaatgaaaagacaacccaattaacaaatggccaaaggacctgaatatatagtttcccacagaagatttgatttctgccatgaattcaaagatatacaaatggccgatagggatagattctcaacttcatcagtctcagggaaatgcaaatcaagaccactgtgacagaccacttcacacccactgggatggctatttaaaaagacagctaacaagtgttggtgacgacatggagaaactggaaccctcatactctcttggcgacgatgcaaaatggcccagccactttggaaaacactctgggagttcttaatgttcaacatagaggtaccctatgacccagcaattccactcctaggtatgtacccaggagaactgaaaacacatgtccacacagaagtatacacaaatgttcatatcaacattattcctaataggcaaaaattgaaagcccaaaatgtccatcaatgaatgaaatacagtctatttatacgatgaaatattgtccataaaaaggaacgaagtactgacgcatgctacaatgaggatgcaccttgaaaacaccatcttaaagaagccagtcacaaagcacacagagtgtatgtaattctgttcttacgaaatgcccagaataggcacatttagagagacagaaagattagtggctgcctggggcaagggaagctgaggagtgacactaaggatttggggtttcttttggtgggaggtgaaatgttctaaatgtgattgcagtgatggttgtacaactctgaattgtacacttaacggattttatgggatgtgaattatagctcagtaga

SEQ ID NO: 706 - DNA, 18004 bp, Homo sapiens
agtggctggagtggaagtgaggaagagggagagctcctgggcaccagaatgaatggggagggtcctttagggcactgtgaggccattagcttttactcctactgagactggacatcccaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacgacctgagtatttgcagattttggtacctgcaagaggtcctggaaccaataccccatggatactgagggacaactgtaaatagtgaagaaggtccttgcttcccctttgccttccaccatgattgtaagtttcctgaggcttcccagtcatgcttcctgttaagcctgcagaacttgtatcatctttcttgctgcccttgaagagtggtgtccagtgaatctttcaaagaatgatactgagcttcattgttgatgaacaaaaatgcaaatctcacccagagcatgcaggaacatgctataatcactacactcctagaatgtgatctctttcaatattgactgcatccatgccttccacacacttgcaccagttgggaggatggagatgtcatctgggcagagggagaagagcagtaccattcagaggtctgtccctcttaagatatattctctctgtcaacctagaactcaaagggctgtgtgaaaagtttactgtggaaaaagaaattgaaaaaactgccactaagtagcaatggaaggacttttcccgctaagatgaggaactgctcagatcaccagctgcttcaggttaccagcccacacctgtctgtctcacctctgacaaccttgatataaattaaacaatgaataagaacaaaaacaatttaaaactgcgtaatggtccaaaccaccatggatggtgttctgacgatgatacacggggtgaggtctgactcatgagccgctgtccgtgatgacttgacattctcaaaaggaaatcccgaatgttctcactgcatgctgctgcaggccctcatggcagggcatccacaccactggctcaggtgctggttgctccagaatctctcttcagctggcctttttctactgaactgtctgtgagaacatcactgcaggcacggttttctccaaccataattgctgctgccaaagccacctcggacttgggaaagggaaacaacactccactagagagcgtagaatcttagaattcatctacttcattctcctcctggtactctactttcttctacaacgtcccagccgagctgaggtctgagctgtgctgctcaaggctgtcccatgtgaatacagatgcggagaccctgtaagggtaacagaggaagctgtgaacccaggggaagaagataaacttgtggacatatgtgcaaggagcaattttaagtatattgcactaaccaactcatgatctgtaactcctttgttaaggaaaagaatgtatatctacgtcaaacttccatttcagaaagccgaggtcaaaataatgagtcctggggaattcaaacttgtgttaagaaaatgtgtcccagtgtgcaatggctgcaaacagcagcttccttggtagtgtatgcagcctgtttgttgtacgggttgctctaaagggccttggagacagtcctttcagatggatgtacatgtttttgaccttgcactaccccagtgtaggctccaaacaggcatgcgaggtgcctttggaaagccccggggcactgtggccagttggccaagttatcatctccatccgcaccaagctgcagaacaaggagcacgtgattgaggccctgggcagggccaagttcaagtttcctggctgccagaagatccacatctcaaagaagtggggcttcaccaagttcaatgccaatgaatttgaagacatggtggctgagaagcggctcatcccagatggctgtggggtcaagtaccttcccagttgtggccctctagagaagtggtgggccctgcactcatgagggctttcactgtgcttccccctcttaatactcaccaataaattctacttcctgtccacctaaaaaaaaaaaaaaagaaaaagaatgctttaacttcaattacccctctctcttatgtacgtttagtctgttattttagttttatcctgattccctcgcataaacattattattatattaaaaaaaagaaaagaaaagaaaatgtgtagagccgggcacggtggctcatgcctgtaatcctagcactttgggaggctgaggtaggcggatcacaaggtcaagagatccagaccatcctggccaatatggtgaaaccccgtctctactaaaaatacaaaaattagccggacgtggtggtgcatgcctgtaatcccagctactcaggaggctgaggcaggagaattgcttgaacctgggagacggagatgcagtgagccaagatcatgccactacactccagcctgggcaacagagtgagactccacctcaaaaacaacaacaacaatgacaacaaccccaaaaacaaacatgaataaatatcattctccaataaaatcattcatgccagttagggaaccagttaggaggttgttactggaaaccaggtgaaagagattttattggagaatgatatttattcatgttttccctaatgaaccctttaactttactccagttacccttaagattgagttcaagcccttggtatggctgacaacactcagtgagatacggccctggtctcctaatccaatcccatctttttcctctgtcccctctttcaccaacttctttcagttctttgaacaggaaaccctttgtttttactcctttacatcagttgctcccttaaaaactcttcctcattccctactctgccctgttttaggtttcagcttagagtaattttctccaggaggtttcccgctggcctccccaatgggagttagtggcggtcaaagcatgctgttctcatcacagcccttagagcactgtattgcaaaagccatttcagttgtctacgtcttctgctagattgggggtttcttggtctttcttgtttaccattgtatccccgcagctagcatagttctagcttgggattaggtgctcaataagaacctgatgaatggccagacagatgaatgaaagaaggttttccttttctgacaagagaaggtggtgaatggaatagttgggaaaaaatgtagtggctaaaaataaagcaaataaactttttcttacctttgaccagctatatttttcttaaaatagggaaaaaaccaaaaacaaaacactgagaaaagtgtttgctgattggttagttttaaatttttccaccaatgaaatattactgctatgtgcctgttgcttctgttttcttttctattaatatcatgggctttttttttttcacaaaggaatttgttataaaaggacattattcaaggtatcactgtatagaacctgacatttgtaaatggtaacattcagtgaatataatcacttaaactccagagtagataatatacatatatattgaaacctagaggcctggggtttggtcttgtttgtatcattatctgtgtaactagcattaggacattaaactttctatgtttcattgcatttaagtaaatgcatcatcttcaaaatgaactgatgccttttctgatatctcacatgtgaagatataatgaaatgactcatataacaatactgtaagctactctgtaaaacataggtaccaagaagtgtgataggaagggtaacggcccagaagctaggttgccagtagctagtcccattcatactgataattatctactttttctctattgtcttcttatcaaacaaaataaaacataagataagaaggttacacagaatgttgttttgagattccttttagactttatcttttaaaattattattattatactttaagttttgggatacatgtgcagtacgtgcaggtttgttagataggcatacacatgccatggtggtttgatgcacccatcaacccgtcacctacattaggtatttctcttaatgctatccctcccctagctccccaccccatgacaggccctggtgtgtgatgttcccctccctgtgtccatgtgttctcattgttcaacttccgcttatgagtgagaacatgcagtgtttggttttctgttcttgtgttagtttgctgagaatgatggtttccagcttcatccatgtccctgcaaaggacatgaactcatccttttttatgatgcatagtattccatggtatatatgttccacattttgtttatgcagtctatcattgataggcatttgcgctggttccaagtctttgctattgtgaacagtgctgcaataaacacatgtgcatgtgtctttacagtacaatgatttataatcctttgggtatgtgcccagtaatgggattgctgggtcaaatggtatttctggttctagatccttggggaattgccacactgtcttccacaatggttgaactaatttacactcctaccaacagtgtaaaagcattcctatttttccacaccctctccagcatctgttgtttcctgactttttaatgatcaccattctaactggtgtgagatggtatctcattatggttttgatttgcatttctctaatgaccagtgatgacagcctttatcattctaggaaatgaaatgagtactatattctgtacataatcctattaaatttcttaaagaatttgttgccatttaatccatccttgcgtttcatgggttgctgtagttcagtggctgttgtagggaatttgtctcccttctttttctatcccagttattttgtgattttttccagatgtgcatgttctccattgatatatctatgcattgtcttagaaagtttaaaatctacccaggaatctatactagctaaaagctctttgagtgtcccttcacagctatacaagatgtttttagtaattgtgttctgtagagctcagcagctgttatgttacccgagtatttttttttctttcttggcttttaagttgatgtttggaagtctattcccaagtgctcagcctaaaggagagacagttttctgttccccctgctaatgctaaacacacaaataaacaaaacagaacaaaacaaaattccaattaaacagtctgggagattctagttgaatggtggatattagcatctttcaaagctagaccacctgtgcctagacaatttgtggctttctattcttatgtaatacaaggaatagatgtctggcaaaacaaaaaagaatttagaaagtagggatgaaacatgattccttttcagggaggaaaatcacttcattcaagtaccagcttagtttcattgctgcatttgaacctccaaggagagaaatgtggagcagttgatccacagttgtaccttccattgttggtttattaaatgggctcttttgtgcgtgtgtgcaatttcattcagaccgttaatcactacttggagtattcttagctttctacaaattgacaaacatagctgtagggaaatctatgtggaaattctgtttttcagaggtttggcagtttctctttaatgagtcctcagggtatctcaggtttcactaatttgtgtttaattagattggaaaaattcgggcagtaagcgacaagaaccttctgccccataagttggagaaaaccatcactcaggcactcaacaaaaccccttccaaatacatgatgtaatacattcactccagaacagggtatgagccctaaaggatgattcagacatagaaacaaaagttgctgttagaagataaaaagaattatcagtggatgtgtttttgcttgccgctttgacattgctgtggcaggcaagagcaaaggaagaaatgatgccctgagctgatgaaaacaaattccagaagcatttatgaccaagttgtggttagaggaacagaatgaaacataatttttcaaagtttccagaagggcttgtgcatgctgaaacataaccagaaacaatataacatgctacaggaggaatcagtgataaaagtgacattccccacatagacctagttatttacaaagagctgtaagaacgaagggctctgaagcctttaagatgaacaatgttgtaacaggaaaggggtcctgattcagaccgccagagagggttcttggatgttgcataagaaagaattcagggagagcccatagagtaaagtgaaagcaagtttattaagaaagtagaggaataaaagaatggctactccatagacagaacagccccgagggctgctgggtgcccatttttatggttatttctggatgatatgataaacaaggggtggattattcatgcctcccctttttagaccatatagggtaacttcctgtcattgccatggcatttgtaagctgtcatggcactggtgggagtgtagcagtgaggacaaccagaggtcactctcgtggccatcttggttttggtgggttttggctggcttctttactgcaaactgttttatcagcaacgtctttatgacctatatcttgtgctgacctcctaactcatcctatgacttagaatgccttaaccttctgggaacgcagcccagtaggcctcagccttattttacacagctcctattccagatggagttgctctggttcacatgcctctgacaatgtcatatatagagtcagtacagcttcaggattaaaaagctagactccagagtcagacagacatggctgatatcaaatcttgcttccactgatcttgcccaactcacttgacaattttgtgccacaattttctcgttagtgaaatggaataatgattagccctttatcatagcatcaatttgaggaattaggaaatgcttgtaagacattggtaagtattcactagtgtgtgttaacaaatgatgtctattattgctattgttattaacaagatattctggctgtggactccatgtagttccagaacatttggtcacagactgaacatgtccaaaactgtagtctgttaaagcctagacttgggttagaaattgcattttccaaagaatttaaacattgcaggttgtactttccaaagatggctgctacaatagttcctatcccacatgctatgtgataatgtgaccttgccactccttccatgaggaggtggggtttatgttttctcccctttgaaactgggtaggcttgtgactacttcaaccaatagagtatggtagaagtgacactatgcgacttcagaggccaggtccaaaaatgctttcatttgttgcactgaaatactccttctgggagtcctgtctgattcccctggggctgccatgttatgaagaagccaacccacacagagaagccacagatgggtgctccgcttggcagtcttaacctttgagccttttcctctcaaacaccagatatgagtaagtcttcagataattccagctccagccattgatgattagtcttctcatctgagaccccagacctcatggcagagagaagccagccctaatgtctcctttccaattcccaataaatccttgaacataataaattcttgtttgaagccactaagcttttgggtaatttgttacatagcaaagaatacctgggatagaaattctccctggtctggccagttctcccatctatggattttccaacttttctcaatcaagtaattagcatttaccatggccttttaatgcaagtcactgtgctagaacagggataagccaacatagttaaacagaaatatacacaaggataaagaatacttaggaatcctatggtaagaactgtgtagcatagagtagtgcaggcaggactatggtgtaaacttaaaagaggctgagacaatctgggaaggcttcatggtaaagaggcttgcatagggccttggataagtggtactcggataaatagaaaagggagaaaatgaattcctggcaaaagtgtgaaaaaatgttttggaaaaaaaaaagatttaggcattgcctcttataattaatctgttaaagtcatatttgtcttgcaaaataatatttacaagaaagaatgcttttagatatatttctaattctaagagaatttacttagtactttatagaggttgagttatgtcagtggtgtcttaaattggactaatttccataggattgatcagcaaactttgcctcctatgtaaacataatttacaactttattagaacacacagaattttctttccttttttttttttgaaatggcgtctcgctctgtcgcccaggctggagtgcagtggtgtgatctcagctcactgcaagctctgcctcctgggttcacaccattctcctgcctcagcctcctgagcagctgggaccacactttttttttattattatattttaagttctggggtacatgtgcagaacgtgcaggtttgttagataggcatacacgtgccatggtggtttgctgaacccatcacccgtcatctacattaggtatttatcctgatgctatccctcccctagcccccaacccccagacaggccccagtgtgtgatgttcctctccctgtgtccatgtgttctcattgttcaactcccacttatgagtgagaacatgtggtgtttggttttctgttcctgtgttagtctgctgagaatgttggtttccagcttcatccatgtccctgcaaaggacatgaactcatccttttttatggctgcatagtattccatggtgtatatgtgccatgttttctttatgcagtctatcattgatgggcatttgggttggttccaagtctttgctattgtgaaccatgctgcaataaacatatatgtgcatgtttctttacagtagaacggtttataatcctttgggtatgtacccagtaatgggattgctgcatcaaatggtatttctggttctagatccttgaggaattgccacactgtcttccacaatggttgaactaatttacactcccaccaacagtgtaaaagcattcctatttctccacatcctctccagcatctgctatttcctgactttttaatgatcaccattctaactggcatgagatgttatctcattgtggttttgatttgcatttatctaatgaccagtgatgatgaggtttttttcatacgtttgttggccgcataaatgtcttcttttgagaagtgtctgctcatatccttcgcccagtttttgatggggttgtttgtttttttcttgtaaatttgtttaagttctttgtagattctagatattagccctttgtcagatggaaagattgcaaaaattttctcatattctgtaggttgcctgctcactctgatgatagtttcttttgctgtgcagaagctctttagtttaattagatcccatttgtaaattatgacttctgttgtcgttgcttttggtgttttagtcatgaagtctttgcccatgcctatatcctgaatggtattgcctaggttttcttctagggcttttatggttttaggtcttacgtttatgtctttaatccatcttgagttaatttttgtataaggtgtgaggaaggggtttggtttcagttttcttcatatggctagtcagttttcccaacaccatttattaaatagggaatcttttccccattgcttgtttttgtcaggtttgtcaaagatcagatggttgtagatgtgtggtgttatttctgaggcctctgttctagaacactcagaattttcaactaattccaacaaatataacgtcttataatagacattcgtcatctcaaagttacacatcggtagtctttagaactgttacatcaaaaaattcttgagaaagctctttgccctttttaggaaatatatttagataaatacccaaattttaatgacaagatatagcatagatatagctataacttacattttataaataacatataaatattcacaaaacaccttccttttaaaaaaacaaaaacaaaaagtaatggctaaaccaagcttttgcgttcttaaggtcctgtgacaacttttcattaagtaccgtagaaatgtgtgggcttgcattttttctttttctttttttttttttttaagatggagcttcgctcttgtcacccaggctgcagtgcaatggcatgatcttggctcactgcaacctctgcctcctgggttcaagtgattctcctgcctcagcctcctgagtagctgtgactacaggtgtatgccactacacctggataatgtttttgtatttttggtagcgacatggtttcaccattttggccaggctggtcttgaaatcctgacctcaggtgatccacccaccttggcctcccaaagtgttgggatgacagttgtgtgccaccacgcctggcctggacttgcattttaactataatttaaaattttttgcaaccggtttgaacataattagtggctggagtgtatcacttcttaaatagtgaattctgctgaatagctcaacttcctgctcatgcttacattggggcatcctatctccctttaagtcctcccttttgaccttagtccttctctttggatagcatagaataaggattctctttcctgtgtgacaagcattcaattgctcaagggcagcacctataccacctttgtgccttctcttttggctaacaattccatgtcttctcatatgaccatctttccagaaccttctttatctttattgttgtcttttaaatcgtttccagaatgtcattcttaaaatgttgcctagaacaaatgaatactctagctgttaataattgccttgattatcagatagtagatatttagcttgatctaagtctaaccattgggaagcgattcctttttttttttttaattttggaaaaagtgttttatgacaactaatttggtgatataaaaatgtccatcagcttggattctttgagaacatcccaaaatgtattggaaatccataatctctgtatccaaaggaatctttgaaactttggcatcatcctagatattaggtagattttcttgggaggatttttggctaaaatgagtcacttacctcttccttaatctagaatttttttttcaggtaatctagagtctctattatatatgtgtgatatatggtatacctgggtctgccgatagacagacaggccaagataggcctgcagtattatctttggttattccaatgccatagccactagccccatatggccatttacgtttgaagttaaaaacatttgaataaaattcaagtaaaaatttagttcctccattgcaccagccacatttaagtgctcagcagtcacatgtggctagtgactgctatattggtcagcacagatatagatcatttccctcattgctgaaaatcccattcctgccacctagataaaaatgtagaaaatgtgaaaatttctgaatatttaaaatggaaaataatatgatgaaaatggatattggcataggctaggcattaaaagcattaactattttattattttgtataatgcctagttcaatgttttacaagggaagcctattgaataagactttagctttgtagacaggccacctgagttcaggttctgccttcaccattttctgcgtgatcttaacctaggctttgtttccttaactataaaatagttttaatgaatttcttaagatgatcattaagctcgaatgaaataatgcttgtaaaagtatttagcacaatgtctgacacatataagttgttaatataaacataaggcattattgcaattatttggagaaatgtaattattagctccaaagtactaattgcagaatacgtgcataaacaccaacacaatataacactttattaaataaattggacttgttaaaaagcaaacagaaagcacagatacaacagcctgtgccacctaacttccaggagacacaggtgtagtgatctgggtgggtttccaaagccttcctcatttggtttggttggtaggggagcacaagcacttccttctcctacactattctgtgttgagggaatgcataaaccactgacaagtctccaagaacatcttcaccactcaggttcttagaagtgatgaaccaaaactccatctttgtatgtgtcaggggcccatatatcaagatgtatagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctccaggggtcatcactttgtgctcagagtacagctgtcaactagtgatttggtgcatttagacaaggaacaggagcaaagggcctatttcaagagggtcatagacactgccttgtgataagtgaatggctagagggtttcttggtaaactgaagtccttttcacatttttagctttttctgtggcaacctgtcttttacagaagctactcatgaactctggcttttcattttcagggttgggctggacattctttgtttttttgttttgttttgttttctgagacagagtctctctccatcacccaggctggagtgcagtggcgtgatctcagctcactgcaatctctgtctctcgggttcaagtgattctcctgcctcagcctcccgagtagttgggactacagtttcatgctaccacgcccaggtaatttttgtaattttaatagagacagggttttgccatgttggccaggctggtctcgaactcctgacctcaagtgatccacctgccttggtctcccagaatgctaggattacaggagtgagccaccgcgcccggccttggacattcatttctgattcactgatcacactgtgtattaaaagaaatgttggtccagtgacaaagaaaaacgacctattctattcctcgccatcacatagctatttggagtaaagtattccaaagtaatgctttactgttcactgtctgtgagaatgatgccatgccccactgtccttgattaaccatttatcatttctcagagatacagagttaggtgacccttcaaattaatgacattctgttcacacataaaattacctcccagttcttgatctgctttcttaatgcccttctgactggctagaaacacttagaattgggcattaagattgaagaatttacttataattatttgaaaatcatataaagagagatggcaattctttttctaggtaggaagcctattggaaatgatgatggtaagcatactggtgatgagaaagcaagcccagaacattcctagaagcatgtgggaacacttggtatctcccgcaaccctctgcttcaaataaacaactagcttttcttggacctatggataagactgttctttaggaatgaactagggagcagctatctgaataagtgatttaatgatgttacgctgttggagtatattccctatctgttgactcgtgccaaagatgccattaataaagctttattcttttgattcttattaaaatacaaagttctcaggatctcaatttccttaccttttaacttgatcattttagaatagatagtctataaaagtggctttaattctgaagtatacatttttttaaagcactcctggaattatttcaggctgtaatcagttaaaatgatcatttagtatatgtttgttattgaatgaatgcatttacatcttactgcaaataaattatacgtccatacttaaaatcaggctttactacagagcaaggaaagagtctataaaagatctaattcttctccaggaatccaataaatatatcttgacagattattttggataagacaccatttcagtactaggttgcttagtagtaatacaagttgcagatggtgtctgcaacttggagactaagaacaaaaaagacaagcttaggccagcgcagtagttcatgcctgtaatcccagcactttgggaggccgaagtgagtggatcacttgaggtcaggagttctagactaccttggtcaacatggtgaaaccccgtctctactaaaaatacaaaaattagctgtacatgtttgtgcatgcctatagtctcagctcctggggaggctgaggcaggagaattgctagaacccgggaggtggaggttgcagtgattcgagatcatgccactgcactccagcctgggtgacagagtgagataccattgcaaaaaaaaaaaaaaaaaaaaaaaaaaagacaagctttacccacttcatagtttttctcgaactcctgacctcaagtgatccacctgccttggcctcccagagtgctgggattacaggcatgagccaccgtacccagccaaataaatatgtgtgttaattagccttgatatatattagccttatttctctttgattatatttaatacctagatcatctatatctggttgcataatgtagcctgaataaaaggaaagaggaaatatgaaaaaaatagcatctattgagggtttaatatagtgctaatcacctcatatagacattttcatgtaatcatcgtagttactctatcaaatagatactattattatatcttttatagataaggaaacagaggctcaaagaagtaatgtaacctgcccaaagtcacatacctagagccagtattatgatattagatggtcttactctagaaccaatagcttaaccattactctagaggaaaaatcattcattgggtgcatatcatatgagctgcaatgttacctaactcacacagagaagagagtcatttcttttcaagaaactgcaggtgatatttacagttccaagaatagtttaggtaaattttgaatgacagagtttcatttggcttcttagcaaggtaatcttttaattttggaagggctttttggaaagcagttcccagagatgatcctggagtggtcctggtaagattaacctgtgttcaagtcttggttctgttgctcaaatgtatgcacatttgggtagcattctattttattcctttatctataaaatgggaccaatgctcatggaggtgtggtgattaatagagttaatatatatactcagtggcctataaaagcatggtgcaaataagtagattcaatagtagtatagagataatcaagagaagccattgtcatattttcacttcttagtacaatgacacatctagtttgtatatctggactacattaggattatcagatctttgaccaaataagatgcttgataaaagtttaaacatgaattaaaagattgatcaaagaccatggacaggctatttctggagaaggctaagatctaatccttctctagcaatccaataaatatatcttgacagattattttggataagacaccattttagtactaggttgcttagtagtaatacagagatggcctctgcatctttgcagaataactagctcagaaaaagtctttccagagctgagatttcaaggtttccatctcaaaagcctacttcattctggattgcgctcagccatcattctttccagttcaccttcagctccaaaagctcacagcagcattatttcacagtgggctttccattatgtgccgactgcacttgatcctggagaagagcactttccaggacttttcctagagtcctagcaatacaggtcatcaaaaacaaggtctgattttccaaagtcaatatttaggaatactttttgctcttggtcacttcaaaaatccaccaggtaactataatggttaaaattattcctttttcctagtaaggaaccctttttgagattggatctttatgcatattttgcagagagtgtctaagggagactcaactaagctccatagctgctatgattgtgaatagttatgagactattgacatgaattagtgatgcattcccacagcccttcactcctttatggttgaatttcagtggatgcctgggggctcttctgccttaagagatcctgtgtcagagccctaggatttctcatcagtcaaaacaccttcaaagtttgaactaaattcacacaaaattaaatgctgcctactggaactataattggttatgacgtgtcttctctgcagtgattcttgacagctttgaacgactttatgtcattaccttctgaggctttgcaaaccaaatgtatcatttgtacaaagcaatgccagggcttggttgccttaaacattcagaagcaactaactgatactagactcttgacttctagtacataatggatcattatgcaatctacaatgaagcccagagtgcaaaatataaatttgagcttttaagatgaaaattaggcacacaggttttctagagagaaaagtatttaggatctacttattggcatctcagacatgaatccatctgtttgctgagtgcgttgctctccactgtggtgccttggcatttgcttcacatgtttcttctgatgtgcaaaccaagcagtaatagcataatattgatctccatttttttttatacacctaggagtgaactcttccattcatttaccatttttgcaagcctataattacaatgctttgatatttggtaaagtaaatggtgcagcagaaattatatgttaatggtttcccatgatttaaatatttaatattctaggttttctatacttgaatgagattacatgagaatattctatttcttttaaaaatctttgtgtaatagtgtaaaatttctttttgttcttggctaagttagttaatgtctcatatatttgatgaaacctaattctaagagtggtggaatttttgatacctctcctttatttccaagacaggcaatattacatagtaattaagaatgtgaactccatactggagtttgaatattggctttaccacttaataatgatgtgacctcattaataaaatgggaaaaatgataatacttacctcccagagttcatttgttctataaacacttgttgaacaccttctgtgtgcctgtgtcagaaaatttgctaaccacccagaatacaaaagtgaacaataccacgtggtcactgcctttctgggatttgcagtcttacatgggaatgttgtcttctgattaccagttcacttggctttattctaaatttagtactgaatttacatttgttgaattatttagtctctgataatcgataacaaatttgactaaatgaatatgaatatactaatttatttacacaatgggttgggaaatttataatgtataaatattaaatttaaaaggacacaaagttcaaagcatgatgtgggccattaaataaaaacaaaccaataagcaaacaaaggacggaaagagaaatgaatgtcataggcaggagagtagataaaatgtaagagagacttgtatggggtattatgagtgagatgaattttcaatttaatatacagaaaaattatgaagaaagcattcaaaagtgttgaggtctatgttatcatggcaaaattaaaagcaaatattcttctgaccttaagaggctgaaattaaaagaaaacttcagtagtcaagaacacagagaatctaaaagtaaatcttttcattttaagcaacatatttgaaaacaaaggaatggaaatatctgtttgatgaaggaaaaaattataataaagtaagcattccacaaattcagttgtttcatacatttgcagttaaagaatattaatcattaaaacaattttatacagctctttaagctatcaaaactcttcccctttctcccagtctggtctccaccaaataagctgaatgatataaaggtggtccctgaattct

SEQ ID NO: 707 - DNA, 2186 bp, Homo sapiens
cactatcatggagggaggatgggtttgtagagtgtcttaggatcaaagcctgacactatgtgtcattgtgtgtcactgagcccctcaatatatccactggggtttgatcgaaaaggaagagccactatgagtgatatagaatgaagacatttgggggaattagaccttacacaattgtgggagctgattcaacagtctgcccaatgcagctgttgccatgtccagtgttggtcctaagtcagtagagccagcagttggaaaggagagatgagtgtgaagagggggagagtaagactagattagaacccatgaagacaaactgggaccctggaggacaaactggaactcacatttgtctcactctctttcagtgatgcaagtgacctgcaggattcactggtgccccacagagctgcacaagctggcccaggatttggagaagcagaagattcgacaacttggaggtccttgggctaaatggaggagaagggtatacagagctgagagccaaggaagccgatgaggaattgcacttgggtgtggagaacaaaactacgtggccattgattgactcaggagctctgctggaggtgcccttggctccctgcatcttaatcctggcctgagaatggtcagtctacttgagggccagtaatacgatcttaaaccttcatgacttacgcctcagagacctagtgccgcacttgacccacaagaggactcttgaacaccagctgtaacatccaccccttttgcttctgttgcctcttctgggagccctgacgggaaaacccagtgaggttgaggatacaggggtttgtgggagacctccgtctctggaacgaatcccccactcctccatcatgcccaccacactggctgcttgatttctctgccacactctagcttttctctctgaaaaacaacttgccagtaacacagcaagaaggctcagggctctgaactattgtgtgcatcccaggtggactcagtccccagatggaagaaggacaagtctccatctcagagacagggagtgggaaggtaactggaattttacctgtgcaaagtgccctacatccaggtgatatttcatcctgctctgttccttcgtaaaggtctccagcgagcagaagggttccatgagccttactcctctggtcccaggccttgccaggcacatgttgcttttccctgggagtagggctgggcactcctgcctccccatgcccatcagccatggggttccctttaaaggctctggattgagcacagtcacctctaatgggaccatggaggaccagcccagcaacctagagctgcttcccaggctgcctgggaatcatttcattttctatttgcagaatcacagatgttgacttttgatctcttcctctctcccttgggggcctcaaatcagtgatgacagctatttcatttctttttaattttttttcttttccctataaagagaaaaggtcagaaagggctcagaaaggttttgaaaatattggaagagctacatactggctactggaatgcaaaagaaaagctctagccctctctatggaaagctcatggcaatgaccaggcagaggctggggtgggcactctttaaggcagtaatgttaacctttagtgtgtctgtaaatcattcaggagtcttgttattaatacaatgcaaattcagattcaataggtctaatgcactcccaggcaaggtccatgctgccagcccagaaccatgcttagaggaacaggtgctgagtttcttcctcacctccaccttgccccagtcctgaatcctgcaatctgtaaatgctccctgctatcttcatgcagttgagtcttaacaggcaagaagccagccaagcgagaatctctcagcagacactttaatcaaattaaaacccacatttagatttttatcacttttgatcatttaaacagaagaactttcagatatatatagatttccaaagaagggatcacaagaggacactcaggtgaggggtggggagttggtggcagtgttgggggggctttcttctctcaccccattctatcccctttgacttattcatttcttttaaatagcatttggctcaactattatgatcttatgctgaaccttttgccatcccatgaatgggcaagcctctgtatacccagtgaaaattaccttt

SEQ ID NO: 708 - DNA, 1963 bp, Homo sapiens
cttattaaaaatagaatattgcctacatcacataaagggcaaactccgccctcacttggtcacagaagcaattacagcattgtctgtagtacacagcccacggcctctaaccacagtgatgggcacacttggtgatgtgcaactcagtggggcctacagggtcccagctgacatagacatcacaaaggaatttgaaccaggactcagaaatagggtctctgggtgctttaaaaaagctgtttaagagaaaaagcagaaagactgtagtgattgtcaagtgcaaggagttctgcattccagacaaacaaatgcagtgtgcagacaacagacagagcggcaagggaaccccctcagcacaaggggacggcggcagataggcaaaaaggtaattactacatgtctgcctttcatgaaaggcagccaccctccttggtgtggcttggaacttcaattctggctaccaggatacagaggtggaggaagagaaggctgaacaccacccccgtctcccaacacacaccctcgaggcaagaaagatatcaagttctcattttgttgcaagaaaactacattctccttttgataataagcaaaaaaatacttctacatttttcaaatagtacctggtcggaactgttccaaacccagagaaaaaagcaataaacactgaaatcccctggcggtctctgagttgaagatgtaggcaggaagtattccatatcttcaaggtttttagggagaagcaagaaaacggtagaggaagggtagaggaggcctcccaggaggcctgggagtgaagtgtacccatcctatgaaagctggaacctttaggaaacagaatcaggagaatgctgactttaaatttaaattaccttgctgaaaaggattggcccaacacaggacaagcagcagtctttggaatgaatgcatcttttactgacctatgcctctctttcagaggtcacggctgtcttcaccctcttctttgcatgtatctcaagcctatgtaattaacaccaatatttttactcacatctgagaaaggagaccaagggcatcaaaagacatggcagtgctgggacttggcttcagaaatgcactttgctcaaggaaattctctgagccgccagtacaaacagttagagacggtgatgcacttcaaaagttatagcagaaaatagagatgagccagtaagataactgcataattgcaccctataggagaagatccttaaggggaaaatgatggacccccatagatacagaacagctaaggcatcatgctgcaagacatcccagcaatgaaaactgaagaagagaatggcactagcctgcaatggtcaagaagggaaggaagtgttcacccaagcgtgaggctgaggagttggagcacagaaggtgacactgattatgaagatttcccaacaaagagctggctacagtgaaaagagccctagttttcaactttcattttatctcacctacattgtctatgctgacccacacatcaagcttcagaagtagatcctggatgcctattttttaggaaaataagttcaaagttacagcttacgcaagtgcagttcttcaatgtccatgctctttgcactaccctgggcttacaccaggaattcagataagcatggactgtctgcttatgtgcagggatgtactggtctcaagtcagttaccatctgaaagctaaaaaaagggagtcaaaaggaccacaaagatgaagccacttctgacaccaaaggaaatgtgtcttctgctcacctttgtaggggccaggaaagaaaatgtaccccaagtacagatccataatttggggccagagtctcatttgacccctgtgagattcttcatgatccactctaaagctttaagccaccaaattcgatgtatttataagggagtcaaaccacatcacatgtgcaagttcaaagaatctgatgttcgaatc

SEQ ID NO: 709 - DNA, 1251 bp, Homo sapiens
cacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtc

SEQ ID NO: 710 - DNA, 4104 bp, Homo sapiens
agaagcaataggagatatatctcttattacattaagtctcctattgcttctgtttctctggagaactctaatacataaaagattatgattagaattatgcttgaagaaggttaatcttataatggcatgcagagcggagctgggcaaggccagaggctaaatatggagccagaaagatactgcagaaagtgagcaaaaaggatgagtggatggcctggggtggaatccgtgaaaaagggcagattgtcagtctcaggaaatcaacaggactgagttctaacttcagctgggctactatgccctggggaaaaatgcaatagacaaaggagaaacagccagagaccttgaccaacagaactatattaaaccagtaaaacaaaaagtattccatgtgtgctccagtaagaaagaagaaaggaaggctcaacatttctatcatgaggacttcttccagcagagaggctccacaggagacctttcattgaccttcactgagaaataccgaatatgtcatgactttcttcaactccacctcttcagtccatgctatcagttgaggtttatgagagctgagctatcatttctaaagacagaggaatttgttccaaaaatatctggctttccacccccaccttcatttataaaacaaaccatctaagtctttcaggctatttttccaccagcttgtttataatgtggtaatgattatgctaataccagttgggaatacattctatgtggacatgttgtgggaatgtgattggagtgtgtgggggagaggagagggctgtataagtgcatgaggagagctattctataaaattatagtacatgccctctttccatatttactagtttttgtaagctccttctcaaatgggaaatagaccatgcttcctttccagaaggatagttattgaataacgaacaccatgtgttctgctatgtcttatttgtctgagcactctgcagctattttctaaaccaaattaataacagtatactaaactgatttccctagtgaaaactgctggctactaccaatgtcagtatgtacaccccactgctccccaaagcttaggtaatcactgcataaccaaagtctacaacagccccagagtgggggcaaggcagctttcatggtacacaagggaaaattgacagcctctaattaaatgagactgtttacacaagcgatagagtattacaacactttccctacaaaaagaagagaatgtgaaatttcagaaaagacagatttaatgtggaacttgtcaccaccgtcagcttcggcatgataaaatgcacatggaaagtcccttgcagcaagcccgctgcaaagaagattcttccttcgtctgggtcagagggtgtggatgtctctaaagaaaatgctacctctcctttgctcacacacccacttgcggcacagtgagctttccacagcatatatgggatctgtgggctgaatgctggagacacaggggccagagcctggcagtgaagactcctgggttatggaggaaaaaggaagtatctcctttctacaaattaagaaaatgcacatccacatgacagcttaacacaggacaccgggtgtgtacagaaactgccctaaaaaaaaaaaaaaaaacctcccaccttcacccaagccaagaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaagagcccaggggtcttccaagtacagtcactactaagaaaatgtcttcagtaaattttttttttttttttttgagatggagtctcgctctgtcgcccaggctggaatgtagtggcacgatctcagctcactgcaagctctgcctcccgggttcacgccatcctcctgcctcagcctcccaagtagctgagactacaggcacctgccaccatgcccggctaattttttttgtatttttagtagagacggggtttcactgtattagccaggatggtcttaatctcctgacctcatgatccgcccgcctcggcctcccaaagtgctgggattacaggcgtgagcccccgcgcccagccttcagtaaaattttaatgcatgttgcttatcattctttgtattgtaagcaccaatccttaatctgtgctgtggtttttgttcagaaacatttctttaaaaaaatttccccagacgctcagccttcatattctaatctttattattctgaactacctacaaagctaaatataccttgtctacatgcagtgcttatgtaacaatggtgcttattttgttttacattgcttcaacctctgaccagaaacttagaggacagaatgccctgcttttacaaaaaatgtggtgaccacaacggtaaccttatctaattgagaccattttaggaaggaggggaggagatatttttactgcaaagactgagtcataagccttcattttttaccctgggttgtgcagaaactttaaactttctatattatttcatttcttccataccaggacatttatttcctattcagtgacaatcttgatgtcttcatccttcaaactgctctctaacatagtttcaaaatccaagcattaaacattattaatgctcaggggatgaatatgttcattacctttactgtagtgatgatttcctatggcaaaatgttaaatgatgtaaagataaaaataattatcatagttattaatcatagcaataaaactggactacctaaagcacagtttatggtataatatttatgaattaagagcaacacaaataataatgttaattgctcacctacagatgaatgcaaatgaggatataacagagtcgaaataaactaagcaaaggaaacaatgtttcatagctatcgtgttcattattctaaccaaaaaaaagaacacagaaatcagatatatgcaatagggtacactgaaatgattctcaatgattatataaaacatatatacattattttctcaacttcctgaaacatcaattctcttgctcataatgtagttaaatcgtctaagattagcctcatgtgaccatgtttggacttcttaaaaaaatcgcttcaggaacattacattttcatgatcagatagtttcctgaaagtattaaacaaaactaggaaaagtgtttaatagttatttggattacatttcattaaaaatctttacgatctctgttaacagtccagtacatttgaatgttaaggaggaccctgcactgaaggttttataatgctttatctattccaagttatacaacacaaaaattttctcaaacaagcacatgtgactttgcctacatctgcatttaagattctaatgtacatttttttattcttttgtttaaattattaactatcaacactagaattgagcatggtatgtattcagaattatgttcaagtaattagtggctattttgttaataaagatgaagcttcaattgtagatttgataattttaccctaaaatttttaaatatataaaaaatagcattttttaaaactataatggtaaggcaaaatgttctcatcagattcggtgggcagatgggacagggaacacagctttcctgaacctggaactcacagttctgccacgcagctatagcaaaa

SEQ ID NO: 711 - DNA, 1165 bp, Homo sapiens
gagccaagatcgcgccactgccttccagcctgggcgacagagcgaaactccgtctcaaaaacaaacaaaaaccccaaaacacaaaaagacataaaaactatttggataactctagcatttacccaagatgttaaggaatctaaaagggagttcttaaagacaatagatgagacaaagccatttccagtgtcggcccatttaataaactggttccacctggattttctcttcattgtggtgaaagccaccacctaacaatgctggccctgcctgcatcatcgcatgtcatcatgacaacctatgggggagaacagctccattcaacagatgcagaaactgcaggttaaagggtgaaaagcagttgcgaagtccccacagcttggaaatggtggagccgagactgaaacccaggtgtgctagcatctaaagttcatgctctttccaccacattagactgtattctgagggcaccaaggaagctccatttttcttaagaaaccaaattgcagtcctccaggaccacagccaggggagcatcttcgtgggagagtggctgctgctcagagttgtgactcccatccttaagagtcctctgtcctctctggcctcctttctactgatcattgctgtccccttcacaggggagaggggccatggcctatcccctaaagagtctgccaaggtagactcataacctccccgtggcacagctcagacaagctgggctatttacataagacttgacccagggcttgaggacagcgcgaggaatgaggtgcagaggagactgctgcttctgggtgacagtctgcctggctgaccacagctggggtactcattggcctcttgaggccccccacaggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctggtctctctgtgcctgctttactgcccttcgctttcct

SEQ ID NO: 712 - DNA, 1761 bp, Homo sapiens
tctgtataaaaattgtattaaatgctaatatacaaaatgaagaccttagtatagttacatagcagatttctacactgagaaagcaaagttcagccttgtgtctccccagcataatctttagtagcccttcacagactgtaaagacggcctttctcttttgctctgttgatacttctcttatttgggtaaatgatctaggggaagagaaggagcagttttatagctattgtagctcctgggtgttttgaatcacttcctacttttgatctgttacttctgttcacttccagtctagaattcccttagtaggttggataagttaagggccttatgacatggtaaactggttcgtatgtgtcaaggtctgtgtgtacagtcattttggggaaagaattatgccgaagcacaataacacatttcttagctggaatgctgagaagctagggaattctgattaactggttagtcacgattcagctagactcttttagtttcatctccattgttgaaaaatttatctaaaatataccagtctattttcttttctttttctttttctttttctttttttttttttttttgagacagggtctcactctgttgctcagactggagtgcagcggcttcatcatggctcactgcagtcttgacctcccaggactcaggtgatcctcccacctcagcctcccatgtagcaaggactgcaggtgcgcacttccatgcctagccaattttttatattttttgtagagacagggtttcaccatgttgcccaggctggtttcaaactcctgagctcaagtgatctgctcatgttggcctcccaaagtgctgggattataggcgtgatgaaactctttttttatgtgttaaagatattagctctttcttaatgatgaaggcttttgcagagttttatttattatgtttttttttttgagacagagtctccctttgttgcccaagctggagtgcagtggggcgatcttggctcactgcaacctctgcctcctgggttcaagcgattctcttgcctcagcctcccgagtaactgagattacaggtgggtgccaccacgcccagctaattttttgtatttttagtagagagggggttttgtcatgttggccaggctggtcttgaactcctgacctcaagtgatccgcccgccttggcctcccaaagtgctgggattataggcgtgagccaccgcaccctgccttgcagggttttagtcgtgattttttttttttttttctggttgttgtcttttttttagcgacacggtcttgctcttttgcctagcttggagtgcagtggcatgatcatagctcactgtaaccttgaactcctgggctgaagcagtcctctcacctcagcctcccaagtagttaggactacaggtgtgtgccactgctcctggctaattaaaaaatatatatatattttgtagaaaggtggtcttactatgttgcccaggctggtcttgaactcctggggtcaagtgatcctctgccttggcttttcaaagcgctgagattacaaacgtgagccactgcacctagccctttaaaaaaaaaaatgttgttactagatagaattataattctaggtgtcatgttaccgtcaggcttttccctaatacagagatttttgggggcactgagggtgaagggaattgtttttgttttataagcctaataaatggtaggcttttggctatttttgtgcgtgaatgtatatacacacaccaaaagaagc

SEQ ID NO: 713 - DNA, 2148 bp, Homo sapiens
aaagaggagcctgctggtctgctggcgggcaggcggcgctgggccggagcctctccctccggtgcgcacagcgcaccctctcctcccccggccgcccgtcgcagcgcggagagggcgtgtcggcaccctgcctggcgagcgcccacccctacaatggctgcgagcgcgcgggacggagggtgcaccgccgctccccggggacttgcacgggtggcgcgcctagcccagagcccgcttgtagtgagcgctcagtagggcgggaaagctgctgccgctactgcggccttctgagaagacgcccattctctgatgtcaggactgcatcgccgagtcctgattgcaaatagcgaaatatataattaaggagagttcgggggcgtatcctgcaatgggatgccgagttcgataaagttgcaggatgctgggaaagtggattgatttgctgttgctaaatgaatggaaacagcgttagagcttctgtccacgatccatcagtctatcgagattgctgattgcctatgacttggacggttgatggttttcaggcccactgagagcagccagcgttggtataaccgcagggagccctcctgggaggttgaacctgcagagcgcaaatgtgcccaggttgatttggggcctagtggtccattttcacagctccactgcctatctgcataaccaggagccctcattcagatgaacgccaaatgggccagagggaggagaatcaaatgagcaacttttaaaagatattaagacataggcacctaactccggacagttcctttaacccttgagctaaccatttgaagcacaaaacataacaaaagaaaagactggggggagtggggccaaaagaaaccaagtgcaaaattctgtacacttgtgtcagattcactccgtaatgggaaaaggtctggctttgaaaactttatggatcaaagggatgcatggagttacacagcacagctgcagaagataatgttcccctggatcactctgcccaactcttaactgcaacccaccttccccatccgtctccccgaaatcacccggaagggtgttaccttcaggaagtaactgatctcttgatcacccctgctggatcctgtccccaagggcgttcgaatgcatccgactcatcttcaccttgccaataacgggtgcttgacacatcgtttgctgccaatcattattgtgattttaatactattggtattctaactatcaagatgactgcttgtagagccagattgcctggattcaaactccagttcacaacctactaactgtatgcctttaggtaaactcagatgcctctgatggattcgaaataaccagatatatttctgaattgcttcatatgatgaagaaactgaggcacagaaggtgggtcaggagggaggaagcaaaagagctagaattcaaacatagcagcatgacttcgagcccactgtcttaaccacttcagataactgcctctaatgcaaagacccctctcgaaggtcagaagtttcacaaacactgccttaagtctcatggctaactgggaggccccacagagcaacgtggctgtgcattagactcacctgaggagcttttaaaacatacctaagcttggctaggcacggtggctcacatgtataatccaagcactttgggaagctgaggtgggaggatcacctgagcctaggagctcaagaccagcctgggcaacatagtgggaccgcatctgtacaaaaaattagacagctgtgatggcatgtgcctacagtcccagctactcaggaggctgaggtgagaggatcgcttgagtgcaggatgtcaagtctgcagtgagatgtgttcacaccattgcattccagcctggatgacagaacgagaacttgtctcaattaaaaaacaaaacaaaacaaacaaaaaaaaaacaaaacccaagcttgaagcaaataccataatggggtaacatttgggaaatctaatgaaggggaaatgagatatctttgtactattcttgcaacatttctataagtctgaaattatgtcaaaataaaaaattaaaagaaaaaagaatgaattagaataatattcattgacctggagggatttctgcagaaattattgtcttcatagtaagatccagaa

SEQ ID NO: 714 - DNA, 2337 bp, Homo sapiens
agtttcccagcgcaccacgccggattccgggcgtcggcgtacaggatcccagagaaggcttcccgccggagcagcggtcgcgggcggttcacctggctgcgcaggggtcccagatattcagagaagagctgaggctcagcctgtcctgccctctggattaattgccctggttgatcacgtttccttgggttctggatctgctcctccagcccccatattttggaaacaagtgtcatttagaatagggggtgggaggccgggcacagtggctcacgcctgtaatcccagcactttgagaggccgaggcggacggatcatgagatcaggagttcgagaccagcctgaccaacatggtgaaacccactctctactaaaaatacaaaaattagccggacgtggtggcgcgcgcctccatctcaaaaaaaaaaaaaattgggggatggggaggtgtgggttgcgggaggtgtgggttgcagttgtgttttcaaagcaatgtttactatctggccgggcgcagtggctcatgcctgtaatcccagtactttgggagaccgggtggatcatgaggtcaggagttccagaccagcctaaccaacatggtgaaaccgcgtctctactaaaaatacaaaaactagccggctgtggtggcacgcgcctgtaatcccagctactcaggaggctgaggcaggagaatcgcttgaacccgggaggcggaggttgcagtgagaccggatcgctctccactgggcgacagatttgaatctacgctgtgcccatcttgcagatgaagatttccccaagccgttacagatggttccctacccattccagagctgctaattataaccaccagcttcaggcggtaggctgagacctttattgttttgtgtcatttagtcatcagtaaaccccatggaataaagcaaagtatgtctgctctacaaatgagaaaattgaggcccagagagactgcccaaggtccctcacagtaaaagaatgtctgaggattcaaacccatatcattttgatgccacaaagccagtgtgcccttgaccctccatcgcccaggaccttaaaatttcctgacagtgactggcattctccctgcgggttgtgaacaggaaactgcatttcagggatggacggtggcgggagcagtcgctctcgggagcctctccttcccctggctgtgggaccctagaggctggtgtccgctgagctggaaactggacttctgcccagatctttgaacgaccccacggtccagcggcagctgtggctggggtctatcccagagtccattgcccctctctgggttaaaaggatagcccacctggttgcagagattgaaaggactaattgtgaaaatgcttttcaaaggagaaagtgtaatatgcaaataccaaatattacactatatttcaaggactcattttaatactttatactctgttaactaaatgcattataatattccttccattgttggaggaaaaatctggttgctcattgtctttcatttcatgtcttcaaaactagtatcttaatcagtaatgctttccttcataatagattgtgttcatatgtattctctcttcccttcaaatttcctatctactcactttgaaaggaaatttctgaaattcatttctatgcatttccctcctcactttttttctgcacaaagttcaaaactatattataggtgaaaaaataaaaccaagaaatgaagggaaggttgaactatgaaatcaacatagcattgtgatctcccaacgctgatatacccagagtgaacaatttgccttgctacagaaaattagtcacagacttgttgcagctgaagtgagcaggatcatgaagttccttttgtttgttgaatatgttattaagtcttcctcggttttaataatgttgaactgtttttttattactcctattatgttttgctgggcatttgtttaaagataatacatcagttttgtaaccttgtagcaatataagttattgatgataaatactccccttctttctttctgcaggaataatattttcactgcagctttggggtcatgcctaaaagtggcttgaaccaaattgaaatagcaatttgaaaaaaccccagatcaatctaaaatgttatttttttaaccaaagcatgttcaagatttgaaaatgtatcctctattttcaaaagtatacatataatttatcctagaacttaatattactgaacatagataacctcagaccacccaaatattctccaaagcaaatcttaatcatacctttaattaatttaatcgcaatttctgattcactttttttttttttttt

SEQ ID NO: 715 - DNA, 3877 bp, Homo sapiens
aagttgcaaaaacagcacagtagtttccaatatatacccctcacccagcttccacaaaaccacgggccgatgattaaaacctggaaattaacaatgatcctgtcctattaatagactgcactaaaatctcaccagttgctccactcgtgttttttccttgtctagatcttactcacatttaggtgtcatgtcttgtttgtcttccccagtctgggatggtccccagtctttttctgtctgtcattactgtgatgctttggaagaactcaggccagtggctttgtggcacatctctccttttgggtttccctgatggtttctcaggattagttggaggttctgcattcttggcaggacccccatggagtgatgctgtgtcctgagtatttcatcatgtggatgtgtcctcatacaggtgacattaactctgatcgcttggttaaggtgctgtctgccaggtttctgcactggaaaggtactatttttttttttttttttggtcaaaggagcagggtataaaaggcagggcatgaaatctgagagcaggcatgcatcaggaattaggaaccaggaactgggagctgaggctgctgctctctgaggaaaaggagactttcaagaagatttaaaaagaatggagaaagaagattcaagaagatgaagatgtcaaatgcctcattgcaaaatatagattggaaagtgttcctttaatttggcattttgtgggtcatttgtgattttggtaaattatgcaatgtgaaaaaatagacagtttctttcaaatggcaagcaattaaagaaaaaaaagtcataagtgtgggctgtagcaacagtgaggctcttattgttgtcattgtctgacagaaatctgaactctgatcccacaaatttctctgctcccttttccctgctcactttgaactgaagaacctctttactccttccttcctttccctccctcttatctccttgcctccctgtagattccatcacagcttcctccatccttttttttcaattatactttaagttctagggtacatgtgcacaacttgcaggtttgttacatatgtatacatgtgccatgttggtgtgctgcacccattaactcgtcatttacattaggtatatctcctaatgctatccctccctccaccgcacaacaggccccagtgtttgatgttccccttcctgtgtccatgtgttctcattgttcaggattacaggcgtgagccaccgcgcccggcccctgactttttaatgatcgccattctaactggcatgagatggtatctcattggggaacatcttaaaagaaaagcatataattgccatttgcacttcctcacctctttatccactcttcagcctactgcaaattgacttttgacctctttaatctactgaaatggctcatgcaaagagactttttataaaaatcacatataatttagattttttattttctgcataaatctctttaattttatgtgataatacagtgcatgattatttgttgagccgttaattttgtattagccaaagagaaagttgaacctgtcagttaaactgggtggaataagaaataatattttaaaattagcagtaaatagaaacttgcacaataaaaatatttttgtgtcacttgaaatattaccattggttgcaagttttaaagatgtaaaaggtgtcttctttcacgttcactttttttttcagtagagatactgactgcaggcagcttgcctcttttgtttttttggcttatagtcacagtatttgagcacaaatttaatgaagcattgtttaattgagacttccctgtagtgacacaacaatattgcaaatttttttcataggcatttcctcacttaattctcaaacaagttttgtcttttttttttcatcacgatatctgtagacaggatcaaacaacttttgaagggtatttgatttccccctatttacagatttaagaaactgaaactcaaaagagacaaattgccacattcatcctgccacagggtgtgtgtgtgtgtgtgtgtgtgtgtgtgtgtgtgtgtgtgtgtgtgtgtgttttctgactctaaacgtagagcagtttctactatgccccagccacttggatgtagtatgtgtacaaaagtgacaacacgatatagtgattcttcaaagtaggtttattgttctaattgacatttttcttcaaacattataggattatacatttccaacaattttaagcaattttgatgcttatcaaaatgttgtatatttaataagtttttgcattaaatgagtttaggttggcaataaggaaccaccatatactttaatagatactatttcataccacagttgtgttgtctttaatacagagatgagtgtttaatactcttttgcaatgggaagaagttaaaggagtttgagttaaaatagtgagagaaataattgaatatgattgttaccttaaatatagccacagtctgttgatttaagcttcagttagtcctaacatattcaacatattcataacaaaattttttgggcatctctggctcatttattaatacctatgaacctgcaaaacactgctgtatttgtaagactgatatgtatgggataatgtatgcgataagcaaaaatcttagttttctagctagcttttgaaatgaaagtaatggaaacatgactactcagatttaaaaaaaccaggctttacctttcgtagttcaatttatattagtacaaattcttctcaaaggtggtctccttgagaaggtgcacaggctactggaaatagtgaagacagtaataagaagaagattaactggcttacttaccaagaaaatgaattcaggaaatttgattctcgtagagatctagaacaagcaaacaggatgaacaaccacttattttggaatagtgtatttaaatttgagaaagagtgatcttttctttctccgaagggttaagaatgtgatcaaaagcctggagctgaaagaaggataatatgtatgggagacagtgaggacacttgcctgaccagagcaggtgaacacctatgtacaataaagctagattgtagtggctgcagtgggtgttgaaatacatgttgaatgcaacaaagaggtattaaaatttcttgaatgttaatagattggcctaatcctgggttttaggcagagcatcctacaaccttaacaaatggtgaatttggaagcaactagactcagggagatcagctatactgttttgtagaattttgaatttcataagccaataaagctcctagaaaattcttaaggactaacatatggttatcaattatttatcttgaaggaaagaatattttaaaaaccccaacaacaaaatataaacagtaaattaccacatactatcttcactgtttcatacaggaatgaaattttaacatcaaatcagcaggaaggacatactcccagagtaaaggacacaacactaagatgaataaacttgatgttcttagagacctaccacattgcctctgttttctcactttctcctctacctgtaactctgtgatatagctgcacagatactcagaatgatagctgagatccactgagctaagagaataccgtaattactcaggcataacataatgaaaacctgggaaagaagaagaaagaataagagaaggaagggagaggatggaagaatgatagcccatggcaacagattgaatatagaaagtaaaagaagaaagtgaaagctacctgcaaaaattatactatgatctcatgtcgttttttgtttgtttgttttgttttgttttgttttttgagacggagtctcgctctgtctctcaggctggagtgcagtggcgtaatctcgg

SEQ ID NO: 716 - DNA, 2233 bp, Homo sapiens
aatttcagggccgttgtcgcctccgggcggtccgcgggtcccgagcggactgggactctggagacgtgcccccaaccccaccgccattcaccctgtcattgcaggggagagaacagaataaagacgggtacattttccatctcacctctgaacctcggttaggaaaacgctgtagccctgactagtgggctcaagggccgactggaaaagggcgagtcagcgttcaaagccgattcggggcagccctctctaacgcagagggccgaggataagaagacgacaatgtgttaggggccctccgggctaggactgtcctcaccactttgtacattgccaaagtaaatataacgtagaggtcaagcgcaggcgctttgtgggcagacatgactgagctccactcgcgactcctctaatggcgtgccagctgcggacctcattagccccgcctcaatcattcagtatgttttggttgtctacagtgtacgaagccctgttctcacaattagataaaatgagtgtgaagtgctcaacataattcctagtgtagtaggccttcaaagaactattatcattattaattactcatatagaatacaactttatgaaatgataggatcccattttaagatgaggaaaatgaggctatcagagacgttaaggaacttaatgtcacacagttaataaacgatagaggtgcgatttgaacacaggttgtctaataccagacctgcatttataactgctgcttcccaagttatagatatttcagcattttatgtagtcacaattgaagaccaaatatttagttacagactaagttggcatgttattactgaataagatgctaaggtatctactaaagattttaagtgcaaaaggcattagagaagaatttactgtggattttttgcaggttctgattgtaattgtatcaccttgagaaaggaggaaatgaaagcagattatcaggcatacttttttaactctaagcaactttttgcattactttctaaggaccatcagcaacaaaaatcaatggtttctaatgttgatatattttcctctaccaaaaaaattaaagcagctgagccaacaaaaattctctgttttggatgtgttagcatgaggaaatggcgaataggaaatgagcttttgcttctcatgtaggaaccctgaaggagtcagatttgggaggggttgaagtctgcttccaacagaagcaggggtggagaagggaaaggaaagacttctggtgtcctaaatgctagtcccaaagtggggatgctgtttgtccggataacccttgtaaatctgctccattctgcagctactcctgggaaacttaactcagccaaataatgcaaacaattgcatccatcatcagccacatcagccttaggagatacatccatatcatgagaaaacactacctgaaattggggaccactggaggattaaagaacaaggagatggctggctatttaagaaggaaaggcagaggctgcagaaattgagcctaacggcttatcagatgggatggataattctttaagtttaaaagaactactcattttccccaacatctgtctttgccatcttcctatctaaggaacctttcactttttagctggggacatagctttctggtatgagaactacactgctcaaacttccaatcagcttgtatgcacttggtgaatcttacctaccacaaacagaagtctggaaagtgaaaatttatttccttttcaccatgaccagccttgttcagaacatctgagaggcacagacctgagaaagaatccccaggctgaagaggtagaagttggcagaagttaaaagcaatgtctccacaatggagaagtgacatgctaaaggaacctggcatctagacatttcctaacccccaatccctccttacatatgacctgctcttagaggagtacagcgtggtggttaggagtgtggactcggcagccagaaatcctgggatctgttgcttgttagctgtgggccttaagctaagaacttaacctctctgtgcctcagttgctccatctgttcaaatgaagataatgataatgaagatgatatcacctgctgtgtaggattgttatgaaaaatcaagaattaatatttgtaaatcacttacagggtctggcacataataagtgctgtgtgggtgtttgttaaataaaataatatacaatgacataggcattgtggttgttct

SEQ ID NO: 717 - DNA, 2172 bp, Homo sapiens
caataaccccagcattggagagagtggagcagcccttcaagaagttccaacctctgcccaggactggttttaccaacttcactaggcttagaatcgtaggaagtctatttgggacttgcgagtctcacgtattcctgcctaaatgtttatggatacctgtttagagctgaaatcttttcagctcccataatatgagggaattaggtctcaaagaagatcatgtattttgatcagaccttatagctgagcagtggaaagaaaaaaaatcagtgtgagatctcccagggttccgcaggagtggcttccttagtccaactggcagcctatcctggaatattgcctgggagagaggttagttgcttttcctggtgctaggaactgaatggttttacatattgatcaatgaaaatacttatttggcctacaataggtgcaaaaatactgctaattactaacagtatctcttctttgctgcgtgccagacactccactgggcattatgcagttaatatgtaccatgaatttcccgtggttagcaatgatgtcaggcatagaaaagacatgaaattatgatgtcaaatgaataaactggaaaaaggaatttcttgaattttctccagctgtcctaagaatgtatctatactttgatcctggcctaccttttcaacatctaaactttattcccccaagcttctagatattcaaagttaagtattaaataaaatcagtaaatatatacaagcttgtttggccattctgaataaggttatatttccaccacacaatctccaaattctctagcagaagggatcagtatgttatagataccccctttccttccctccctggcaagccaccacatctgttatgggtactcaatgcagtggctgcacctgggcctcactcattaagcagttgttgattgagtgactgaattgaatgcctgatgagctcgcaagtaagattcagactgtgcctgcaaactaataggatccctccgctttttattcactactgctgaggtagatctcaggccagcctgaagtttaggtctactgagaaataataagcctcaaaaatcgagctttgcttcacccagtctcccagtaaacactaagaaatgttcacattatttacacatcctagactgcctgtcttatggaccaaatgtttgtgttctccccgcaatttatacattggaatcctaaccctcaatgtaatagcattaggtgctggggtctttgggaggtgattggctaatggacctggagccctcatgatgggatgagtccccttatcagaagagacctgagaaggcttgcttcctctccctgtgctcttcatgatgtgaagacacaagaagacagccatctgtgggccaggaagaggtcctcactggaacccaaccatgctggcaccccaatcttgaatttctagcttcaagaacttgggaaataaatgtaagccagccagcttatggatttgttacagcagcctaagctaagtcagagtctctagaacagctggtctggggcagcggtgaagggaggtgggtgggcatatgaccctgccctgcacatgaatggcaaaggcaactggagagcctctcccttttggtgagatccccagtccacaagggcatgttcatccatagctttacttcccgaagcaaattctggttcctggggcctgtgcctccatagatggcatgatctgcagcctcctgtggtaatttaccctcttcctaaatttctgagtcttcacatttaagcaatcctagttagatatcctctacctgtatccatggctgtctttcagtcacattacagactcattgtgatgaccatgtagggacaatgtgatttcagaaacatggcctcatttgattttaatgtaaatataaatcagtgaagcagaaaaagagaatctccagaaaaacaagggatgaggctgtacagcaagttaaagtggaatcagaacccaactgtagtccattatttgtttcaatcctgctcttttctaccatatcacccagtttccaaatcgttcagcaaattgccatggtcaatgggattaacctttcccttttattctcaggaaatctcccttgtccattttgcaagactgtgtgattctttctactgttacaaggaataaaagccttcctaaaaa

SEQ ID NO: 718 - DNA, 1893 bp, Homo sapiens
gcggggggcggggtgcggggagaggaaagcgccgcgggtggcacggtgcctctggcgacagagtagatggacccgaaagagacccgaggtgacttcgggctgggcaggacacccccgggagttgccagcggctctcagcgggcgcctctaggaccccttgtcactgcgagcagcgcctgctctggggaggggctcgaaggcgccgcgccttctcaacgcgccgctgcgtcccccaggggctccaacttggacagctagactggaaatactgctgcacaaagttaggctgagttcgaaggacaccagagaggaagcgcaaggagatgcccttctccggagccgggcagagcgccagaactcctagacgggaaactttcccccattgaagctagaaccggtcatgcgactcggctaagtgtggggaaacactggctctagactccagctataccacaggaaactctctaaaaagagcagtatgagtactatgagaaatgagccaattctaatcttccctacatgcagaaggcactgtcacagatggtgagcacacagccacataaggctatgacccttctctactcatcccctctttgtgtggttgtaccttgaggaatcagaagctcagctgctgagcacaaaacaagataatcaaagatggtggaagaagtcaattggatgtctcctccctaatggggtttccagatctgaagcagtgtcaagctgatagaagagacaagggaggatgatgttgacaacagatgttgaccatgtggatgtaacaggtcagcgctttgccctggaaagcacttgttaacagcagctcaagagagaatacccaatgaagcaattatgtgtggagatatctgaaggtgagggttcagtggatgcatgtgcaagtttgctacctgggtaaaccacatgacgctaagtttgagatatgaatgatcacgtcattcagatagtgagtatagtacccaacaggtagtttttcaatccttgccccaccccaacactcccttatctagtagccaccagtgtctattgttcccatctttatgtccatgtgtactcaatgtttagttcccatttataaatgagaacatgcattatttggttttctgttccttcattcatttgcttaggataatgtcctccagctgcatccatgttgctgcaaaagacgtgatttccttctttttcatggctgtgtagtattccatgctatatatgcaccacattttctttatccagtcccaatctgtattttaaataatccctgtgggaattctgatgcagatggttagcccctcatacttcagaaaatacagatcagaggcacatgaagtcagagaaatgtgtggctgtttttgacatgcatgctttgctcagatagcgcttggaaagaaggccacttacctggttttgttcactctacgggccaacaattggctgcatggtcaacatgtgatttaaaaattaagatacttccttaaaccactgctgaaggagtcagtgacttgaggtttcaaaaaacaacacaaaaactagttgaaaaggactcaacctggaatgtagaataaaatatttattatttactcaacagttaatgtaaacaaacatgtatacagcaaactcttaggagctgttaatttctcattcctcttcacagaatgactaaagaagctttagcgtagatgaggtgggggtaatgtttttgtcctcttattgcacgactcctcatttatttgacttggcttaatgggatctactgattcttatcttgcctcacaaatgtgaatgtcaattccggcatgtggtacactgtgctaattttaatatttttagactatttgtaattgttcataaagatcttcatcaattatacctcta

SEQ ID NO: 719 - DNA, 3790 bp, Homo sapiens
atttgtggtctcctctcttggctttggagcccccctccctctgtctctgtacgggggtgccttcttcttttcttcttctcccttctttcttgcctattaaactctccacttcttaataccactacacgtgtatctgtgtcattttatccaatttgcatgagacaagagccctggtgcccctccactcatcagagccgtatcattttggtgcatgggccaggaaaatccaaagtacagccttcgttggagtgatagagtctcaccgttgcccaggctggagggcagttgtgccattttggtgcactgcagcctctgcctctggagttcaactgattctcctgcctcagcctcctgagtagctgggactagaggcacacgccaccatgcctggctaatttttgtatttttagtagagagtgggttacaccctgttggccaggctgctcttgaactcctggcctcaagtgatctgcccaccttggcctcccacagtgcgattacaggtgtgagccaccgtgcctgcccggcctttttaagagatgtggtcttgctgtgttgcctgggctggtctcaaagtcctgacctcaagtgatccacccatctcagcctcccacagtgctgggattacaggcatgagccactgcaccggaagtctaggtttaattattccccattactgagacaagatcttcctgagcactctaccccatgcctagcgaatgatcagtttttccagctggccagtgggaagaggtcctggccctacctcgtgtgaatcttgggcgttgtttcctcgaatcctttcagctggttctttccctggccttggagagtttcttcacacacatgtgctgattagttctttgctgaatcctctgaagtcctctggggtactctctctgtgcacctctgtcttgtaggtgttccattatctaagctctagctgctgtggtctcctcggactcagccactccatttcctcaactctgcgaatcctctgggctgcaacaacccacatcccccttgccctgccccacactttggaaacgctctcgaagcagtaaactgcacagtcctaaaaggactgttgatgtcctttctctctgggatttcattgcttttgttactttctctcattgcttgatgttcagcgttttgaacactgttgttccatgtattgggtctgtttttgtcactgtggtggtggtgattgtttcagacaggagggcggacccagcccacgtgactccatcttggctggaagcaggaatctcgggatcagtggtttcaaagctcctcaggtgattccaggggacgctgaggtgaggaccacttgcagagactcctctgcttgaaatatctctcaatcaaatggaatcttcttttgttgttcccaccccttcattttctctgttctctctttctgagttttttctttgtttttgttttttgagacaaggtcatgctgtgttgcccaggatggagtgcagtggtgccatcacggctcactgtagcctcaacctcccgggctcaaacaatcctcctgccccagcctcacgagcagctgggaccacaggcccataccatcacgtccagctatgttctctctttctggaacttctgttaaacaaatatggattgaattgattctccatctcttttctttcatattttcctttcttttctttcttttttgttggcattttgctctacatcctgagaggtgtttcaaaacttttccacccgtaccttcctttgattaattttttatttaacttaattaattaattaatttttgagacatggtctcactctgtcacccaggctggagtgcagtggtgcaatctcagctcactgcagactcaacctcctgggctcaagtgatcctcctacctcagcctcctgagtagctgggagtacagatgcactccaccatgcccggctaattattttattttttgtagagatggggttttgccatgtttcccaggctgtgatggatttttaaatttggtccgtcgtatttgtgacttccagaactttgtcttgttctccaattgcagcatcttcctggaagcctcttcttggttcgtggtgcattatcttattcattcctttcctccagggctagtgttctgctattcttcctttcttttttttttttgagacagagtcttgctctgttgcccaggctggagcacagtggcgtgatctcagctcactgcaagctccagctcctgggttcacgccattcttctgcctcagcctcccgagtagctgggactacaggtgcctgccactacgcccggctaatttttttgtattttcagtagacatggagtttcaccatgttagccaggatggtcttgatctcctgacctcatgatccacccgccttagccttccaaagtgctgggattacaggcatgagccattgcgcccaggctttttttttttttttttttttttttttgagatggagttttgctcttgttgcccaggctggagtgccacctgcagcccagtgatcttggctcactgcaacctctgcctcctaggttcacgcaattttcgtgcctcagcctcccgagtagctgggattacagtcatgtgccaccatgcccggctaattttatatttttactagagatggggtttcaccatgttggccaggctggtctcgaattccagacctcaggtgatccaccctcctcagcctcccagtaagccactgcacccaaccatctgctattcatcttaatcctctctggtggcaccgaaatgaagaggagacccatgtggatctccctgcagccgggtgagtctggttccacaggaggccttttcctgaactggctgcaggctccgcgggcaggtctgttaattggttaaaatgcttcattcagttaggtgggttttgttcccttctccccacccagaggacatttgggaatgtcgggagatatttttggttatggcagctagggggatccttctgacacctagtggatagaggccagaaatgccactaagtatcctaggacatgcaggagagcctctcaacgattaagaatcagctgtcccaacatgttaatagcacataggtcggagagacaccctgatttaaggccatctgagtacaggctccccagctctcaccaccaaaggccaagataaggagggtccctctacagccacttcagggaacttccaagggagcttgttcaattatgtttatttattttatttatttattttttttgagacggagtcttgctctgttgcccaggctggagtgcaacctccacctcccaggttcaaacgattctcctgcctcagcctcccaagtagctgggattacaggcacctgccaccacacccagataatttttgtattttttgtagagaaggggtttcatcacgttgcccaggctggtcttgaatgccatgaccgcccccagttgtgcttagaagataccgccaacaggccgggtgcggtggctcatgccttaatcccagtactttgggaggccgaggcagctggatcacgaggtcaggagttcgagcctggccaagatggtgaaaccccgtctctactaaaaataccaaaattggccaggcatggtagctcacgcctgtaatcccagcactttgggaggccaaggtgggtggatcatgaggtcaggagatcaagaccatcctagctaacacggtgaaaccccgtctcaaaaatacaaaaagttagccaagcgtggtggcacacacctgtggtcccagctactcagaaggc

SEQ ID NO: 720 - DNA, 9593 bp, Homo sapiens
attcacagcgtatgacactgctgtcatcatgtctcctggattccttttttttttccctataacagctctatcaagctataattcacatgccttaaaattcaccttttttgaaatgtacaactgagtgatttgtaatatattcacagagttgtgcaatcttaacaactacttaattccagaacatttacatcacttcaaagaaaccccataccctatagcagtcactcccaattctcttcttccacccattccctggaaaccactaatctactttccgtctctttggatttaactactcaggacattttatagtcagcacgtaagccggactgtctaggaaaacctccccttcctgtgtctggaggtgttgaaaaaaataattcaacaatgctgcccctgctggccaccagtgtaccatgcaataattccatggcccctgccacagcccaggaaatggaggaaatggccaggcagccacattctctcatcctgcagaaggacccttctaggtgttagaggttgagggattttggctacatatggccccatacatcttcctagctatagattccaatggaagaagagaactttctttcctctactgagtgcatataaacttctgcatcttgcttctggcctcaacttgatcttcagcatcaacatcaagcagagcagcatgagatgcagtgcaatgaataaacagttcttggtcacgggcttgcccttgcagtctggaaagaaaatcctgcaactgagagagccaccatgatttcctgaagtatttggtgaagaaccattctccaaacgtgaagtcaggagatatgtattgctattatcagagctgaggaaaagacactagaagtttgaaatctcagatgtccacagcatcatgacacatagttaggattccatgctgaatagaagggggaacctactgaagagttttcagcagaagagagacccaataaaacttgcgtgtaaattataaccattgcttctgtatagcattctgattggagagtcaggtatagatgcacagagagcagttagaaggttattatagtagtctagaagtgactgtggacttgtagggaaatggcaaatatttagaaaacaaattcaataacactcagcaatcagttggacttggggtatgaggaagggagaaatgtctggtctgattccatcacaaggccttgtatatgctgttccctttgcctaaaaattcccttagctcctcttttaacctggcgaaatgttgctccttcatcaggtctcagcttgagcatctcttctccagggaaattgatcctcttgcctttcccctgtttaatttcccttcccatcacttatcacagtttataacgttatattcactcacttataaagtactttcttaaatattttagctcctctacaaggatgtataatccttgaagcaggagctgttcccacccaagaaaatgaaaatctcagtcattaagtacacaaacacgggtccagattgcttggtttcaaatcttggttctgctactggccagctgtgtgatccaagaaaagctactcgacttctctgtgtcttcatctgctcatctgtcaaatggatatatgagtagtcctacttcatggagttgttgcgaggaatccattagtacctctcctagtgcctgcagccacgcaatacatatttgaaaagtaagtggaaatctgtcaagtgtaagttactgtgtggatattggtgtgatgcacagagaagaggaagcactggaagatgatcatggaagggagagaaggcaagcttgcaaaatcagcattggctatttaaataatatctgcctatgatgctgtcaaggaaaaatgttgtggagccgttggaaatgtgacattgaagctcaaaacagaggcctgaggggattgattaatttcccagagccgccataataaggtaccacaaactaggtggtttaaaacaataaacatttattgtatcacagttctggtggccagaagtctgaaatcaggtattggcaggattttgccccctgaagggccctagggaaggattctttcttgccattccagcttctggtggtcccaagtgatcattggcttgcagtagcatcaccccagtgtctgcccctgtcttcacatggccttcactctatctgagtccaaatctcccttttcctacgaggatagcagtcatgttgcataaagggtccaactactccagtgtgacttcatcttaactacttacatctgccacagtcctactttcaagaaagttcacattctgaggtattaaggcaatcagtgtttcagtgtatcttttgagaggacataatttcacccacaacagaagtgatatacatttgggggttactggcatttgaatgctattttgagccaaggctatagagaagagcagccttgtagctaagagctcaggtcctatcaatccatacagacctgggattgacactcagttccattactgactggctcagatcttggtaaagttgcctaacatttcgaagacttagtttcttagcctgttaaaaaagggataataaaacctccaggtttcttgtaaatatgaactgaggaaatgattgtaaagtggtgagcatagcacatcttatagggtgagtcttcagtaaatggtgtctgttagttaagattttgtatggaaagaatctaacctgagaaagaaggaagagtgaggaataaatttttaaccaagaggaaacaccccattttagttagaaatgacccaagagagcaaccagaataatgaaaatactataaattattttctggtgttttggatttatatatagttcaagaatttagccctgtgcctgacctaagacagataatcaatatgcagttggatggctagactgaatgaacatcagggacatatttagccaccagaagaggagtattaagggtacataggtagggaaagaggattgaaagttacctagaaatctggaaggctctgatgcagaagagatattatacctactctgtaaatgtggaactagaactaggggatagaaattatagggagaatcatttttactcaatactgaacatttgctgaggtccccaatcctcaatgtttgcaaacagagatggataacacctagccaaatcatttatacaaggtgtctttgtactggggagatggttggattagaggtctgataaatttatttccacctgtgattccaaattgatgttaaagagactataaataagaaacatttattagatgaaaggaatatgatagacacaatttaagaagagacattaagcagtataaaattccttcctatctaatttagtttctaactcagctctattttcaaaggccaaagctaccagcccttgaattcccattacacttattctcccttatgttagattttatatggaggaggaccaacagtttttgagaagcacctctggatcaaaacaatgatccgtaattccttaagtaaaagctagtaatcatattaatgttctttagaagaaagaaagccaagccaggatagtaaaacagaaagcatttcccatcatttttggataaggcagaagacaaagtccagtttctttcgagtctgaaggggaagtttaaaattttcaggactataaaggacaatgcaagagaggcattgaagcgatgggggaagaaaacagtagggggttccctattttaaaaccacttctgaagtgaattctagcttcatcttgccttcattcccagctccatccttgggaatgaaagatttattcttctagctgcctggaattctgctggctgagagctctacattgccaggcttcttcaggaattgcccgagtggaacagggccaccttgcccacaggtattcccttccttgagcaaccctcatttagtgattgatcaattaatgcatcaaaaggtctgacatattcttcaatcattttttaagatcactgtatttatttgaaaaaattgccaaagaagattgtttctttgcgattttgtgttattattattattaaacagctttagtgaggtataatggatataaaataaactgcacttatttatgtataaatagaatgactttggatatatgcatatacctgtgaaatcatcactacaatcaaggtaatagggaaatcaatcacctccaaaagttttcttccattgcaattttaaaagatgtgttttatataccatgtagataaaaatggaaaattggagcaaaaaaaacaacttctttttatgagaacgttaaaaaaaatattttctagatgtaccaattaaaacatgcttaaaataattgcacatttatccaatttagaaatatgtccagtagccattatcattctgaatgttcacttttaattttcgacatggatctacatcggtatagaaaactgcacactttccttttctctgcaaatacggcacaattttattagttattattctcatgttatacaatagatcactggtcttgttcatcctacatatctgccactttgtaacctctaacctacttatccccattttcttcccacccccagctcctggtgacaactcttttatactccatctctgtatatttttactcttctttaaagattccacatgtaagtgagattatgcaacatttttttgtgtctgtcttatttcacttagcagaatatcatccacatccatctattttgggacaaatgctggggtcttcatttttaaggttgaataatatttcattgtgtatgtgtgtgtatattaggcagataatcaataagcaattgaatgacaaaattgaatgaatattaaggacacatacacacacttttttatccattcatttgtcaaggcatacttaggttgtttccatatcttggctatttgtgaataatgttgcaatgatcatgagagtccagatatctttatggagtgattatttcacttccttttggtatatgaccagaaaaggaactgctgggtcatatgatagttctatttttaatttcttttggaagctccacactgtttccattatggctacaccaatctacatctctaccaacagtgtacaagggttcccttttctccacatcaacatttttgccaacatttgctatttcttgactttttgataatagccatcctaaggaatgtgaggtgataactcatagtgggtttgatttgcattttcttagtgactaaaatgttgagcacattttcatatatctgtgggccattttttatgccttcttctctattcaggtcctttgcccaatttttaattgggttgcttgtttttctactgttgaggtgtgtgagtgctttatacattttggatactaaccccttatcagagatatggtttgtaaacatatttttcccaatccataggctgctgtttcatttttttgattgtttcctttatgtagaagcttcttggtttgatgtagtaatatttatttatttattgttatacagcctaagattttggtatagtatccaaatatcattgccaaggccagtgtcaaggaactttccacccatgttctcctcaaggaatgttatggtctcaggtcttacatttaactcttttatctattttgagttgatttttgcatatggtataaaaatccaattttactcttttacatatggaaataaagttttcctagtgccatttactaaagaaactattctttcccaattgtgttctcttggtgcccttgtcaaaacttagttgaccctatgtgttctaattgatttctgggctctgtattctattccactggtcgatatgtctgttttaatggcagtacccatacagttttaattactgtagttttataaaataattttaaatcagtaattataatgccccaattttcttttgcttgcttagaattgctgtggcaatttttttagttcctaagaaattgtggaattatttttcctatttctgtgacaaatgccactgctatttttacagggattgaatctttatgtagctttgaatagtaagaacattttaacaatattgattctttgaatctatgagcataggatgtcttttcgtttatttgtatcttatttaacttgttgcatcagtgggcttggttacatttattcccaggtatttatatgctatcataaatgtgattgttttattgacatatttttcagctaagttattatttatgtataaaaatgctactaattttttgggtgttgattttgtatcctgcaactttacttaattcatttattagttctaaaagtttgtgtgtgtgtgtgtgtatacactctggggttttctacgtataaaatcatgtcatctgcaaatagaaataattttacttctttttttttccaatttgggtgtctttgttttattttcttcctgtttgattagtcttgctaatacttccagtaccatgttgaataaaaaaggcaaaagtaaacacccttgccttgtgtaggattgtagtaaatatcctttcagcttttcttcattgatcatgacgttagttgtgagtttttttaaataaatgatctttattatgttgagaaactttccttttatacctaaactgttgatggcttttatcaagagagaaagttgacctttgttgaatgctttttctgtgtaaagtgggataattacgtggttttaagctttcattctgttaatatgatgtatcacatttattgatttgcatatgttaaaccagacttgcatgccgaggataaattccgcttaatcaggatgtataatctttttgttacgttgaatttgttaatattttattaaggatttctgcatcaatgattctcagagaaattgacctgtaattttcttttattgtgatatagctgcctggcttagatattaaggtgatacttttctcatcaaatgtgtttggaagtactacctctagttttattttgtggaagagtttcaggagtattagtatgaatgaattcttctttgaatgtttggtagaagttatctatgaagccatctgcttctcgggttttctttgttgagaggtgttttattacttctttaatatctttatttgttattgttctgttcaagctctctacctcttcctgtttcaaatcttggtaggttgtatttttctaggaatttatccatttcctctagcctatttaatttgtttgcatgtaattgttcataatagccctttatgatcctttttatttctgaggcaaatgttgtaatgtctctactttcattgttgattttatttattgtttttcatttatccttacttagtctagctaagggtttgttgattttatttttgttaaaaaactcttagttctatttgtttttctatggtgtttgcattttctatttgatttatttctgttttgatctttactatttcttttcttttgcgaactttgagtttagtatgctcctctttttccagtcccttgaggtgtaatgttagattatttactttgaatctcccttcttcttattttgttttgagacagggtctcattctgttgcccatgctggagtgcagtggcacaatcctggctcactgaaacctccacttctggggctcaagcaatcctcccatctcagtctcttgaatagctgggactacaggcacgcatcaccatggcaagctgatttttgtattttttttgtagagatgaggtttcaccatggtgcccaggctggtcttgaactaatgggctcaagttatccacctgcctacacctcccaaagggctgggattactggtgtgagccaccatgcctggccctctttcttgttttttaatatagacatttattgctatgcacttccctcttaaaactacttttgttgcctcccataggttgtgttttgctgtgtttccattacatttgtctccatatacttttagatttcccttgtgatttattgtttgacccattggttgtttctttatccaatcttgccttcccttccatagatattgattctgaaagcacaaccaacctttctgtactctgatctctgtcttaaagtctccttcttagcaaaccaacctgtgctttcttctttcatatcttttctcctttcagctacaatctgatttttcttgtgtttacagcaaaactgaaaagatttttttatattcatcattttcacatccttaccttccattttctcttgaacacacaacaattagacttagttgctgctgctccatagaaactgttcttgtcaaggtcaccacaaattcatcctgtcaagtcccatcatcctcatgttggattacctctcagcaacatctgccatagttaaataatcttcttcccaagaatgtacttggttcctgggatatcacactcacttggttttcctttcctcacttgctgtttcttctcagtatcttttgctgggtcaccttcatctttccaatctttaaatgtctgtgaactccagaacttcatccttgactttcttattcatcttcaattactccctaggtcaaaaatcagcaaacttttcccataaaagaccagatagtaaatattttaaactttagggcaatgtggtttctgctgcacctacttaactctgccattgtagtgcaaaagtttccatatagaatatacaaaaacaaacattttcatgttccaataaaaacaaccaatggccatatttggactgatggttatagtttgtagatctctgttctatgtaatctcatctggttccacaactttaaatgttattactgactaccgtaaattccagactgagatagttaagctgctacttggcatcgctcaaaagtagtatgtactaaaaggaaactttggacttttgttgatctattcctcaacctgtttctctcccagtctttcttactggcaatgcaagacacatcaccatttgcgccttattgataccacctcattacctttatccttcattgccagccaggttcaagacatgaaattcattcatctggattagttcagtagtattgagcaggtctttctgctttccctctaagctcccaagagcctagtctttgtagaatggcaaaaataaatttcttgaacatttcttttaaaaaagaaaattagattttaacatttccttctcattttgaacaaatttcaagcttcttcccaagacccagaaggtcccaaatgatctggtctttcctcacgtttgtggttttgtggtctgttcttcatgctcattccctcccagccacacttgtctttttgctgttttgagtgttcagtttatacttgccatgaggcctttgctgacccctctatttggaaatattttcccccaatttctaacttgcctcatatccttaactaatttgggtttttgtttaaatatcatctcttcagagaaagatgttttgattccctatcttaatagattcctcccatcattacccagttcctttttaccttgctttatcttttaaaaacgatacttaatgagtaccaaaaattattttgtacatttatttctttatttgttatttccctctactacaa

SEQ ID NO: 721 - DNA, 9817 bp, Homo sapiens
attcacagcgtatgacactgctgtcatcatgtctcctggattccttttttttttccctataacagctctatcaagctataattcacatgccttaaaattcaccttttttgaaatgtacaactgagtgatttgtaatatattcacagagttgtgcaatcttaacaactacttaattccagaacatttacatcacttcaaagaaaccccataccctatagcagtcactcccaattctcttcttccacccattccctggaaaccactaatctactttccgtctctttggatttaactactcaggacattttatagtcagcacgtaagccggactgtctaggaaaacctccccttcctgtgtctggaggtgttgaaaaaaataattcaacaatgctgcccctgctggccaccagtgtaccatgcaataattccatggcccctgccacagcccaggaaatggaggaaatggccaggcagccacattctctcatcctgcagaaggacccttctaggtgttagaggttgagggattttggctacatatggccccatacatcttcctagctatagattccaatggaagaagagaactttctttcctctactgagtgcatataaacttctgcatcttgcttctggcctcaacttgatcttcagcatcaacatcaagcagagcagcatgagatgcagtgcaatgaataaacagttcttggtcacgggcttgcccttgcagtctggaaagaaaatcctgcaactgagagagccaccatgatttcctgaagtatttggtgaagaaccattctccaaacgtgaagtcaggagatatgtattgctattatcagagctgaggaaaagacactagaagtttgaaatctcagatgtccacagcatcatgacacatagttaggattccatgctgaatagaagggggaacctactgaagagttttcagcagaagagagacccaataaaacttgcgtgtaaattataaccattgcttctgtatagcattctgattggagagtcaggtatagatgcacagagagcagttagaaggttattatagtagtctagaagtgactgtggacttgtagggaaatggcaaatatttagaaaacaaattcaataacactcagcaatcagttggacttggggtatgaggaagggagaaatgtctggtctgattccatcacaaggccttgtatatgctgttccctttgcctaaaaattcccttagctcctcttttaacctggcgaaatgttgctccttcatcaggtctcagcttgagcatctcttctccagggaaattgatcctcttgcctttcccctgtttaatttcccttcccatcacttatcacagtttataacgttatattcactcacttataaagtactttcttaaatattttagctcctctacaaggatgtataatccttgaagcaggagctgttcccacccaagaaaatgaaaatctcagtcattaagtacacaaacacgggtccagattgcttggtttcaaatcttggttctgctactggccagctgtgtgatccaagaaaagctactcgacttctctgtgtcttcatctgctcatctgtcaaatggatatatgagtagtcctacttcatggagttgttgcgaggaatccattagtacctctcctagtgcctgcagccacgcaatacatatttgaaaagtaagtggaaatctgtcaagtgtaagttactgtgtggatattggtgtgatgcacagagaagaggaagcactggaagatgatcatggaagggagagaaggcaagcttgcaaaatcagcattggctatttaaataatatctgcctatgatgctgtcaaggaaaaatgttgtggagccgttggaaatgtgacattgaagctcaaaacagaggcctgaggggattgattaatttcccagagccgccataataaggtaccacaaactaggtggtttaaaacaataaacatttattgtatcacagttctggtggccagaagtctgaaatcaggtattggcaggattttgccccctgaagggccctagggaaggattctttcttgccattccagcttctggtggtcccaagtgatcattggcttgcagtagcatcaccccagtgtctgcccctgtcttcacatggccttcactctatctgagtccaaatctcccttttcctacgaggatagcagtcatgttgcataaagggtccaactactccagtgtgacttcatcttaactacttacatctgccacagtcctactttcaagaaagttcacattctgaggtattaaggcaatcagtgtttcagtgtatcttttgagaggacataatttcacccacaacagaagtgatatacatttgggggttactggcatttgaatgctattttgagccaaggctatagagaagagcagccttgtagctaagagctcaggtcctatcaatccatacagacctgggattgacactcagttccattactgactggctcagatcttggtaaagttgcctaacatttcgaagacttagtttcttagcctgttaaaaaagggataataaaacctccaggtttcttgtaaatatgaactgaggaaatgattgtaaagtggtgagcatagcacatcttatagggtgagtcttcagtaaatggtgtctgttagttaagattttgtatggaaagaatctaacctgagaaagaaggaagagtgaggaataaatttttaaccaagaggaaacaccccattttagttagaaatgacccaagagagcaaccagaataatgaaaatactataaattattttctggtgttttggatttatatatagttcaagaatttagccctgtgcctgacctaagacagataatcaatatgcagttggatggctagactgaatgaacatcagggacatatttagccaccagaagaggagtattaagggtacataggtagggaaagaggattgaaagttacctagaaatctggaaggctctgatgcagaagagatattatacctactctgtaaatgtggaactagaactaggggatagaaattatagggagaatcatttttactcaatactgaacatttgctgaggtccccaatcctcaatgtttgcaaacagagatggataacacctagccaaatcatttatacaaggtgtctttgtactggggagatggttggattagaggtctgataaatttatttccacctgtgattccaaattgatgttaaagagactataaataagaaacatttattagatgaaaggaatatgatagacacaatttaagaagagacattaagcagtataaaattccttcctatctaatttagtttctaactcagctctattttcaaaggccaaagctaccagcccttgaattcccattacacttattctcccttatgttagattttatatggaggaggaccaacagtttttgagaagcacctctggatcaaaacaatgatccgtaattccttaagtaaaagctagtaatcatattaatgttctttagaagaaagaaagccaagccaggatagtaaaacagaaagcatttcccatcatttttggataaggcagaagacaaagtccagtttctttcgagtctgaaggggaagtttaaaattttcaggactataaaggacaatgcaagagaggcattgaagcgatgggggaagaaaacagtagggggttccctattttaaaaccacttctgaagtgaattctagcttcatcttgccttcattcccagctccatccttgggaatgaaagatttattcttctagctgcctggaattctgctggctgagagctctacattgccaggcttcttcaggaattgcccgagtggaacagggccaccttgcccacaggtattcccttccttgagcaaccctcatttagtgattgatcaattaatgcatcaaaaggtctgacatacttccatcatccagggacgtctctgaaggccatctcagcttcagagctccccatgaagttgactgaagtttttattggattttgtgtcagtcaacttcttcaatcattttttaagatcactgtatttatttgaaaaaattgccaaagaagattgtttctttgcgattttgtgttattattattattaaacagctttagtgaggtataatggatataaaataaactgcacttatttatgtataaatagaatgactttggatatatgcatatacctgtgaaatcatcactacaatcaaggtaatagggaaatcaatcacctccaaaagttttcttccattgcaattttaaaagatgtgttttatataccatgtagataaaaatggaaaattggagcaaaaaaaacaacttctttttatgagaacgttaaaaaaaatattttctagatgtaccaattaaaacatgcttaaaataattgcacatttatccaatttagaaatatgtccagtagccattatcattctgaatgttcacttttaattttcgacatggatctacatcggtatagaaaactgcacactttccttttctctgcaaatacggcacaattttattagttattattctcatgttatacaatagatcactggtcttgttcatcctacatatctgccactttgtaacctctaacctacttatccccattttcttcccacccccagctcctggtgacaactcttttatactccatctctgtatatttttactcttctttaaagattccacatgtaagtgagattatgcaacatttttttgtgtctgtcttatttcacttagcagaatatcatccacatccatctattttgggacaaatgctggggtcttcatttttaaggttgaataatatttcattgtgtatgtgtgtgtatattaggcagataatcaataagcaattgaatgacaaaattgaatgaatattaaggacacatacacacacttttttatccattcatttgtcaaggcatacttaggttgtttccatatcttggctatttgtgaataatgttgcaatgatcatgagagtccagatatctttatggagtgattatttcacttccttttggtatatgaccagaaaaggaactgctgggtcatatgatagttctatttttaatttcttttggaagctccacactgtttccattatggctacaccaatctacatctctaccaacagtgtacaagggttcccttttctccacatcaacatttttgccaacatttgctatttcttgactttttgataatagccatcctaaggaatgtgaggtgataactcatagtgggtttgatttgcattttcttagtgactaaaatgttgagcacattttcatatatctgtgggccattttttatgccttcttctctattcaggtcctttgcccaatttttaattgggttgcttgtttttctactgttgaggtgtgtgagtgctttatacattttggatactaaccccttatcagagatatggtttgtaaacatatttttcccaatccataggctgctgtttcatttttttgattgtttcctttatgtagaagcttcttggtttgatgtagtaatatttatttatttattgttatacagcctaagattttggtatagtatccaaatatcattgccaaggccagtgtcaaggaactttccacccatgttctcctcaaggaatgttatggtctcaggtcttacatttaactcttttatctattttgagttgatttttgcatatggtataaaaatccaattttactcttttacatatggaaataaagttttcctagtgccatttactaaagaaactattctttcccaattgtgttctcttggtgcccttgtcaaaacttagttgaccctatgtgttctaattgatttctgggctctgtattctattccactggtcgatatgtctgttttaatggcagtacccatacagttttaattactgtagttttataaaataattttaaatcagtaattataatgccccaattttcttttgcttgcttagaattgctgtggcaatttttttagttcctaagaaattgtggaattatttttcctatttctgtgacaaatgccactgctatttttacagggattgaatctttatgtagctttgaatagtaagaacattttaacaatattgattctttgaatctatgagcataggatgtcttttcgtttatttgtatcttatttaacttgttgcatcagtgggcttggttacatttattcccaggtatttatatgctatcataaatgtgattgttttattgacatatttttcagctaagttattatttatgtataaaaatgctactaattttttgggtgttgattttgtatcctgcaactttacttaattcatttattagttctaaaagtttgtgtgtgtgtgtgtgtatacactctggggttttctacgtataaaatcatgtcatctgcaaatagaaataattttacttctttttttttccaatttgggtgtctttgttttattttcttcctgtttgattagtcttgctaatacttccagtaccatgttgaataaaaaaggcaaaagtaaacacccttgccttgtgtaggattgtagtaaatatcctttcagcttttcttcattgatcatgacgttagttgtgagtttttttaaataaatgatctttattatgttgagaaactttccttttatacctaaactgttgatggcttttatcaagagagaaagttgacctttgttgaatgctttttctgtgtaaagtgggataattacgtggttttaagctttcattctgttaatatgatgtatcacatttattgatttgcatatgttaaaccagacttgcatgccgaggataaattccgcttaatcaggatgtataatctttttgttacgttgaatttgttaatattttattaaggatttctgcatcaatgattctcagagaaattgacctgtaattttcttttattgtgatatagctgcctggcttagatattaaggtgatacttttctcatcaaatgtgtttggaagtactacctctagttttattttgtggaagagtttcaggagtattagtatgaatgaattcttctttgaatgtttggtagaagttatctatgaagccatctgcttctcgggttttctttgttgagaggtgttttattacttctttaatatctttatttgttattgttctgttcaagctctctacctcttcctgtttcaaatcttggtaggttgtatttttctaggaatttatccatttcctctagcctatttaatttgtttgcatgtaattgttcataatagccctttatgatcctttttatttctgaggcaaatgttgtaatgtctctactttcattgttgattttatttattgtttttcatttatccttacttagtctagctaagggtttgttgattttatttttgttaaaaaactcttagttctatttgtttttctatggtgtttgcattttctatttgatttatttctgttttgatctttactatttcttttcttttgcgaactttgagtttagtatgctcctctttttccagtcccttgaggtgtaatgttagattatttactttgaatctcccttcttcttattttgttttgagacagggtctcattctgttgcccatgctggagtgcagtggcacaatcctggctcactgaaacctccacttctggggctcaagcaatcctcccatctcagtctcttgaatagctgggactacaggcacgcatcaccatggcaagctgatttttgtattttttttgtagagatgaggtttcaccatggtgcccaggctggtcttgaactaatgggctcaagttatccacctgcctacacctcccaaagggctgggattactggtgtgagccaccatgcctggccctctttcttgttttttaatatagacatttattgctatgcacttccctcttaaaactacttttgttgcctcccataggttgtgttttgctgtgtttccattacatttgtctccatatacttttagatttcccttgtgatttattgtttgacccattggttgtttctttatccaatcttgccttcccttccatagatattgattctgaaagcacaaccaacctttctgtactctgatctctgtcttaaagtctccttcttagcaaaccaacctgtgctttcttctttcatatcttttctcctttcagctacaatctgatttttcttgtgtttacagcaaaactgaaaagatttttttatattcatcattttcacatccttaccttccattttctcttgaacacacaacaattagacttagttgctgctgctccatagaaactgttcttgtcaaggtcaccacaaattcatcctgtcaagtcccatcatcctcatgttggattacctctcagcaacatctgccatagttaaataatcttcttcccaagaatgtacttggttcctgggatatcacactcacttggttttcctttcctcacttgctgtttcttctcagtatcttttgctgggtcaccttcatctttccaatctttaaatgtctgtgaactccagaacttcatccttgactttcttattcatcttcaattactccctaggtcaaaaatcagcaaacttttcccataaaagaccagatagtaaatattttaaactttagggcaatgtggtttctgctgcacctacttaactctgccattgtagtgcaaaagtttccatatagaatatacaaaaacaaacattttcatgttccaataaaaacaaccaatggccatatttggactgatggttatagtttgtagatctctgttctatgtaatctcatctggttccacaactttaaatgttattactgactaccgtaaattccagactgagatagttaagctgctacttggcatcgctcaaaagtagtatgtactaaaaggaaactttggacttttgttgatctattcctcaacctgtttctctcccagtctttcttactggcaatgcaagacacatcaccatttgcgccttattgataccacctcattacctttatccttcattgccagccaggttcaagacatgaaattcattcatctggattagttcagtagtattgagcaggtctttctgctttccctctaagctcccaagagcctagtctttgtagaatggcaaaaataaatttcttgaacatttcttttaaaaaagaaaattagattttaacatttccttctcattttgaacaaatttcaagcttcttcccaagacccagaaggtcccaaatgatctggtctttcctcacgtttgtggttttgtggtctgttcttcatgctcattccctcccagccacacttgtctttttgctgttttgagtgttcagtttatacttgccatgaggcctttgctgacccctctatttggaaatattttcccccaatttctaacttgcctcatatccttaactaatttgggtttttgtttaaatatcatctcttcagagaaagatgttttgattccctatcttaatagattcctcccatcattacccagttcctttttaccttgctttatcttttaaaaacgatacttaatgagtaccaaaaattattttgtacatttatttctttatttgttatttccctctactacaataaaaatttgagagggcagagaccatgtgtcatttgtttcttgctctatttatgatgcatataaaagtatgtggaatgtatcaggaaaacaataaaaatttgttattgtttttcatttaagcatgatgt

SEQ ID NO: 722 - DNA, 1321 bp, Homo sapiens
agctaatgaaaaggattatacactatgactaagtgggatttgttcctggagggtgttcaaaatacaaaaatcaaacaatgtaatataccatattaatagaatgaagataaaaatctcacatgttcatcttaactgatggaaattaagcactcaacaaaattaaataccccttactgatataaattactcaacataataaagcctacacagtagatattacttgtattggttcatgttttatacagtcagtgtttatttgtataccaatttcatttttcactgttcctctttcttctcaaacttcctttctggatttaattttttcttcctggaattcgtccttgagaattcctttagtaaggcccattgatgttaaactctttccaagttttgtttttatgaaaaatatattttgctctcatttgtgaaaaacttacatgattctatgttgaattattttgtctcagcatgtagaagataccattctactgtcttccatcttttgttattgctattgagaattctgctggtctaactgcttctttgaagttactctctttgactgtctacctcctttaagtaccttttaaactttcagattctgagttttactaaatgtatccagatggcattaaaaaatttttttctgccttgggtttcattgcatttcatgaatctccaaattcatgcccttctctctccttaaaaatttaccaatcctgaactattgctcaaataaatataatctctaaatatttcctatttcccattttatcaattctctccttttgaaaactccaattaatttttttattaaaccttctcattatatctgccatgtttctaaaactcctttcctagataatttcttcttgactatattctagttcactacttctctcttcatttgtatctaatgggctatttaactgttacactgattttttttctgaccataatttttaatttaggaagtctggttgaacataaaggaagcctatacactggaataaatatgaagctgctgcatatgattcttattccaaaataaggcctaatcagcattaggctgagatcttcattggtggcataagaagttcaaccacttgagtggacataatctccaaggtggaatggacctggtaatggactggatgacatgctggactttaggaatatccacaaatctgcatgaggtctctcctgctacaggccattggtgtggaagagaagatttttctaattgaggttgattatggaatgaaattaaagggtgggaaggaaaggttttcacatatgatcagagaacagagataccact

SEQ ID NO: 723 - DNA, 1995 bp, Homo sapiens
cactttcctgcgagtcgctctccgaagtgtcgctgtccaccggctcctcgtccggggtgtctctcacagccagcagggccactaagtcggggacaccatttttgtcttctttggtgttcaagcggatggattcggccccagctggctccttctctgcctcttctttcttcgatttgtcggtgacggtgaccagagccaagaactcgcggggaccgtcttcttccccctcggagttgcagggcgcccactgcctaaccagctccctggcagcggcctgcagcgtggcgtacagcgcgctctggtcctcttctccgctcaggtcgccctggtcgatctcctcgatcacgatgcccaggctctcgtcggaagagtcctcggcctcactcctcgcgggagcagacggccgtcctcctcggcttctcttcttgcccttctgggtcaacctgttgcgtctggttctgtttctgcgaccccgacggcccctccttgggttcctggctgccccaagaagcgagccagcctgccctgttacctccccagaatcctgggcctgcgtctccgaagcgggaggggtgggtgcctccccgggggtcccagcctccgcggcctgcgtgggcccgtcatccagcagcaggcgtctcatctgcctcaggaccctcgtgtcctgcgcacggtccttccacagaaccctccagaccccatccttgcctgggatctccctgggaatggcagcgtgattgacgtcctccacaaactccaccagggcggcctgggccttctcgttcatcaaagccttcatgtgtcgcaacctgaacgtgcccaggggcaggagggtcggctgcaggacggcttcgacgtctgcctgctccaggccctccgggatgccggtgaccagcagggccctgtgcgcgtccacgtccaggctccggcaccagtcctgcaaaaggctcatggccatggtgcagcccccttggcgctgatcttggggcagcagggagcccgagataggggtgggctgcagcgcacggtgtcaatgcaaccctagaaagccacttgcagggcttagagtcccggttccggtgaatgtggcaaggctggagtggggctcggggctcgggggctctagctgcctgctggccggctggacgcagtgaccttcccccgggacccctctccagagctgtctgaggatccgcggggggcttacgtgtctgctttccaggacagctccctccctctctccctgacacaggcctgagtgactcggcaccgcagccaggtgcaggggggcggcgccgagtgcacctggagaggcgtgggaggtagcagccgcagcttgcctggcgctcgcgccgcgtctgagcgcgcaccctgggcctgaatctcagcagttccgctgcgacgcggctgctcgcgcgtgcgcctgcgcagagggagccgcacaccctcccctgtcccccgcccaaccgtctccatggcaacggtgcagccttgagctggggtctgcgtcgctgtggcctgagacgcttttcttaaaggtcccgatgacaaggacttggggcctggaagcaccactttcattaaccagcaaaaaacaaggccgaaaccacagagggccagaaatcactcaaggatacccgacctcattcaggggatagaggcctccttccagagggtaccggcatcactgggggttacaattcccccttccaggggccaggtggaattcaggattatataggcctaaatcaaagggcactggccttgcagcgtaggaccaggacttactcgggatactggcctcattcacagtatatgggtctcagtatcaaataggggggcccaggcaccacctgtgagcaagacaccattcagggtatatgggcctcacttgcagggtacaggccccactcgatgggaccggccctcactcccatacacgttcctgtattctgaactatgcatgcacaataaatcctgtggttttgcacacgc

SEQ ID NO: 724 - DNA, 1428 bp, Homo sapiens
ggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaagtaaatgacaaatatcctttattctatctcaagccattgcttcttcatcttttttgtgtcatgacaatcacagtgggcggtaatatttgtactgccctctggggaacacagaggagactgctggcacctgaggtgaactatgctgggggcttcagctgccccaggactcctccctaccttgaagcctgaggggatacatatctctctgcacatctctttgtggctcatcaatgggcctcaccatacacgttgaaaagttctagtttaagccatacttacctgttacttggctgaatgcacttctaagtaaaacttggactcaatgctgcttgtcaatggaaagtgatgagatttataagatatcatacattctctagcaacatatgaatatgcaaaaaatactgatcttagcccaaatcacatcatatgattctactgacagaactatttgctatttaactcgtgttctttcttgtcagtaatggggccacttcctgattaactacaggcacatttcatgagatccaaacatagaaatttttctttctttttttttctgagacagagtctcctcagtcgcccaggctggagtgcagtggcacgattttggctgatgcaacctctgcctccggggttcaagtgattctcctgcctcagcttcctgagtagctgggaatacaggcacttgccatcatgcccagccaatttttgtatttttctagagatggggttttcccatgttgactagactggtcttgaactcctgggctcaagtgatcctcctgcctcagccttccaaaatgctgggattacaggcatgagccaccttgcccggcctataggaatgtttcaaacgatgcatttgagagtacattcataatggttgaagaattatagattttagggaaaaaagtttcattttatctagaagttcatcttatgggtcaagttattatgttttttatatggtcttaggtttgggtacacaatgaccttggcaataattgatttttctatgagcctgacattaatgtttctaagcaagtcccttttgtcagctccactggtgcttaccgtagagggttg

SEQ ID NO: 725 - DNA, 2763 bp, Homo sapiens
aggtggataccaccacactgtcttgtagatgttgatgtagtggacgaagagtgctatgagctggcagaagaagagctgcaactcaaacagaatgctggcctggactggcagctcggggatcttgcagtgctgtagaggcacaacagtttgggtggccagaggagggctggagaggcctgttccagaactgctcctgacagtggggagggaacaacatcagcagctgacctgagaatcctaccaggaagggcttctgaggcaaaggattgtgggataagatcagaaaagcagctcatagcaaggacggggtcttcctaatcctgcttgtcagacaaaggaacccgacaaagccttttcctatccctaatcttattcaggtcttccaacaccccctaggagagaaagaattattaggtccatcttacagatgaggaaaaggaggcccagagaagggaggcaacttgtccaagccatcagcaaatctggagcagaactgtaattagaatccaggcctttggatttattctaccatgtcccactgcatctgtccaagtgatcaccctcaactgagctccctctggatcttttctgctgcttactcccctctaagcccccactggcatctaggatttcacatcttagaatccagtcagagagagccctgtccacatcgtccctgtgaggccacagtgaggggtgagacagagaggtggtttacctggtgcgggaacgaacactggtcaccgatgcactggaagtgtggcttccactagagccccccgaggatcccggctcacagagcggatttcgacagtaagatgtcctgttgggacctcttcgtcctcctgtggggctcaacataaaatagagcctcaagccagggggcatatatcaaggataacagcaatgataccagctgccagtcacctagtatctcactttatcatttaatcctcactgagacctatgatctggccccttcttacatcttcagcttcatcccctatcattctctacctcacacccaccctctaccacccgccccatgctctaaacatcttgatctttctttcctcagcaagccaagctcattgctacctctagcacttataatatcctatctggaaagcctttcccggactgccatttctgaagttttgaagtaactccccatcactctctctccaatttctattctttttttccaccagaattcactctctgaaattatcttactcatttgttaatatgcttattgcttgtctgtcctattacaatgaaaggtcaatgaggtcagttaccttatctttttcactgctatatcccctacctcagtgcccagcaagtatatgttgatgagtgaatgaacccagcaaggtaggtttttcacacattaggaaactcagcttacactatgtcacagtatcgtggctgggtcgtgtgctctcaactctggtacacattgggccccattcagacataagtttctggaggcctataactctgggtaactttgggacagctttttcatccagggccccatgattcagctcaaagggcattctgggatctcatgggcaggacccagggcctaaataaagggtcaaggatatggctgggagaatcctgtggctgtggactgaaaaattggacctactaggctgagcagtctagcccaagctcccacgcaccacttcgcacaaaagttctgcacaaagctcctaagcacctaaaaaagtcacaacctgactgggtgtggtggctcacgactgtaatctcagcaatttgtgaggccgaggcgggaggatcgcttgagaccaggagttggagaccagcctgggcaacatggcgaaacccggtctctattaaaaaatatatatacatacatatacatatttttaaaaagttataacctgttcatacctcttcacagtaacacagcagcctccattcacatacaccccacgccgtagcatctcagctcggaagcgtttcccacacttcggagccaattttgggcttggatgtatgcccaaaattataaacctccacaagtctctaaaaagtacctggcgaagagctctgccctccataaacccccagaccagaagctctgttcatacgctgttatacttggcttagaaaatcccacacaaacacccttagtccagtccagaagctctgcccacacccactctcctctctttagaagctctgcacccacataaagcccctcagcccagaagctccgcctacacacaactgtcagcccagaaaccccgcccacaagccaataaaagccctctcagcccagaagccccactccagaatgggctccctcagtcggaagtctccccgctccaccgcccccagtgtaacccctccaacccagaaacgccgactgcactagcgccccctgcccagaatctccacccttagcgctgaagccacgcccactggtaagtcccgcccccctttctagccccgacgagctggtcctcacgaaagcccaagcccccacagggcttcgtcttagaagccccgcccaccgtccaatgtcccgcccccacaacagaggccccaccccgcaaaacgacaggagggggcgggatcccgtctgcgctcgcatcccctccccctcccgtcaccgggctcctgtccgcgtggagcagcaattagcagcctggccatcctaacccgtgcgcccgctcgttgccaggccgagcctgagccgctctgctcacccatctcctccccccggtg

SEQ ID NO: 726 - DNA, 5998 bp, Homo sapiens
gcagccgcctggcgtgcggagagcggcctgtcgcgcgctgggcgcggggactcagggtcccagcagtgggtcgcgcacctgagctatctccatcctcggagaccgacgagctctcagtgtcctcgtcctcggagctgctcccctcattttcggcgtagtccacctccatctcatcgtgatggttggtctccttcttatcccctcgggaatggactggcattttccagccgcgccgtcgctttccactaccggcgcccagcccggccaccgccgcttcaatgaagggcgcgcggaacgccccaacccacccagccaccgagcttgctcgcccccttggctcctccccgcccccggcccgggcctcacaacctaacccgcaggctctgcgatgggagctctgccattggcggaggccttccaccgagccagagggcgggggcttgccctgctctggtacgattggttgcccgcaattacgacgcggccttccgatgcttgccgggagttgtagttcgtaggtctcagacctgcaggggctgcacgcttccatccctcggcagccctgatcacttcttccttctggacttcaagtcccacaaggcacgaaagctgacactctggatcgcagtttataaactaaacagaaacagattgtgcgaatttagtctgtatttatctatttcccgccaagtgattgtttgacctgcctgaccatcagagatgttactgttagatgtgaaaatgtcttttgcctaaaaggatctttgcctgctcattgagcctggggaactggagaaccatctgttttactaagcacctttattacctaccattaataaactgttttatttaattattaactatagacgataacttgcactttctgtgttgtgcaaaaatctttaaattattcttgaaacttttacaatacagaaggtaaggaagttttatcttggcattttcaatctaatatttttggcatttattttttaccaaatgcagtcggaaaatgccatcagtcctgatttaactttagttttcaatgaaaaatacatacttaaccagatgtactttctcaaaaaaagggtacatagctccctctccctctccctcgccctcgccctcgccctcgccctctccacggtctccctctccctctctttccacggtctcccactgatgccgagccgaagctggactgtactgctgccatctcggctcactgcaacctccctgcctgattctcctgcctcagcctgccgagtgcctgcgattgcaggcgcgtgccgccacgcctgactggttttcgtatttttttggtggagacggtttcgctgtgttggccgggctggtctccagctcctaaccgcgaatgatccgccagccccgacctcccgaggtgccgggattgcagacggagtctcgttcactcagtgctcaatggtgcccaggctggagtgcagtggcgtgatctcggctcgctacaaccacctcccagccgcctgccttggcctcccaaagagccgagattgcagcctctgcccggccgccaccccgtctgggaagtgaggagcgtctctgcctggccgcccatcgtctgggatgtgaggagcccctctacctggctgcccagtctggaaagtgaggagcgtctctgcccggccgccatcccatctaggaagtgaggagcgtctctgcctggcagcccatcgtctgggatgtggggagcacctctgccccgccgccccgtctgggatgtgaggagcgcctctgcccagccgcgaccccgtctgggaggtgaggagcgtctctgcccggccaccccgtctgagaagtgaggagaccctctgcccggcaaccgccccgtctgagaagtgaggagcccctccgcccggcagccgccccgtctgagaagaacatctggtggaaccccatgatggcggtcttcatccgccttaagctggcccacaaccatgctgatgatgcagctatgcggcgtgagctgatggtcctgcgcggtgatgctgtgctggattttctggaaccgaaggctagacaacttctccacaatggcagctttcccctggaactgttgtccttcccacgtaaggcatgatgcgtcaatgtaaattgcgcctagttggggtctatcgttatcaaataactggtagtaatgtggaatgaagctggatcctatctgctcccaaattggcttgtctcccactctggaccgtcagccggcctcgcggagacccgaggggctggcacgatggctgcagcggcggcggcaacccagcacggtctcaaaatgctcatatttttaagtggtctcatgcattacgtatgctacaacttgactttctccttagtgacgtttttgagatttacccattgtgattcaggtagctctcatccagttatttttacctgccataacatgttccatttagtaaatatattctattgaatgaatattacagtttacccatttacctattaatggacagggaggctgctcccaattttttcactattaaaaacatttgtctcagacccagcacagtggcttacgcctgtagtgccagcactttggcaggctgaggcaggcggatcgcttgagattgggagttggagaccagcctgggcaacatggcgaaaccccgtctcaacaaaaaatacaaaaattagctgggcgtggtggtgcgtgcctgtagtcccaactacttgggaggttgaggtaggaggatggcttgagcctgggaggtccaggcttcagtgagctgtgattgtgccacttcactccagcctgggtgacagacagagtaagcccctgtctttaaaaaaaaaaaaaaaaaagttgcctccgtgaacattgcatttgtttgtttgtttgtttgtttgtttgcttttttttggacagagttttcctcttgttgcccaggctagagtgcaatggcaccatcttggctcactgcaacctccgactcccaggtttaagcaattctcctgcctccgcctccggagtggctgggattacaggcgccccccaccatgcccggctaattttgtggttttagtagaaatagggtttcaccatgttggtcaggctggtctcgaactcctgatctcaggtgatccgcccacctcagcctcccaaagtgctgggattacaggggtgagccaccgtgcccagcatgaacattgttgtatgcaccttttcttcaggcatatgtgtgagaatttctctaggtcagtgtctccaaagtgggaggagtgtattcgagaactgtatcctggggggcaggaaggaaatattaaaatataaatttataaaatttttaatttcatctttgtttggaataaagtaggtataaggaagcagttagaattccaggttttactctgatttaccctcattatattccttgtgtttgtttttaatcagcagatccagcttctgaaataaagcaaatttaattccaggctccaccacatggtggggcagagacatcagctatacaatccgtaaactttgtctactgattgactcaggccaaatgctaggagttggaaaaacaaagataggacaccagagctgctactaatagctagtatcgaatcaggataaatattctcatcattcgaactaaaggggctttaggacctacactgagaactagatgagaccaacttataattattccaactacgtgaaaatgtgattccaattgcttaagaatgaaacaatcccccaggctcagtggctcacgcctgtaaaaccagtactttgggaggctgaggggggcagatcacttgagccaaggagtttaagaccggcctggtcaacatggtgaaatgccgtctctactaaaaatacaaaaagtagctgagcgtggtggcgcatgcctgtggtcccagctacttgggaggtggaggcatgagaattgcttgaaccttagaggcagaggttgtagtgagccaagatcacaccaccacactccagcctgggtgacagagcaaggctctgtctcaaaaatttgtaagctgaaccaattgaaatgtttatggtgttggctattgtttgtgctgttaatcatcagtcctcttcaatcagggcatgaccaagattaactttttcctcccaaattgatgtggatggtctagctgtgggcttcatcttcaacatcatcttgtcccttcttaaaataagttatctatttgtaaactgctgattcatttggagcatcatccccataaacttcttgtaaagcatcagtgatttcactatccttccatccaagcttcatcataaatttggtgtttgttcttgcttcaacttaagcagaattcacattgctctgataggggctctttacaaactgatgttttattcttctcagtgcctcaaattggattctgtccagacatgttataacaagttaatataagcttattttgttgaaaaaaaattgacatctatagttttggaatttttgttttgttttgtttgttgagacaagttctccctctgtcgcctaggttggagtgcagtggtgtgatcacagctcactgcaacctctgccttccgagctcaagcaatcttcccgcctcagcctcctgagtagctgggactaccggcacgtgccaccatgcctggctaatttttgtattagccatgggcaacatgtctcaccctgttgcccaggctggtcttgactcctgggctcaagccatccacctgcctcggcctcccaaagtgttgggactataggtgtgagccactgcactcagccagttttttttgtttgtttataatacacatttttcatgaactttttgaagaccccctcatatctctctcttaattcttggaaggtaagataacaacctagtttaggtttggtgaggtgaaactttatcacaggtgactccattttgactttcagtctgatctgtgggggcctagtgcaggaacttagtccaaaacaacagcctcctataatttgtatttaacctgaagtactgttctggattcaatagattcattggtgaataaatgagacacagcttatgacttcatagaacttagggaaaagtagagagataaatattaagcagcttgacaaactgaggtatgctctctgatggtgttaggagagtataatacagagacccaattgagattgggagtggacggcaggtaagacctctctaaagtagtaatatttcagctaagacctgagagatgagtaggagttagcccagatcggaatgagaggagggacattataagctgagagaatagtgtatgttaaggtcctgaactagaaaaaaacttggcatattcatgtttgaggaataaagagaccactgtggatggttactaatgttcaagaatgaaagagacacaaggtgtgtttggtgaggtaagcaaaggcttgataaattatggtaaggaaattagattttttaaaatcctaaatacagtggctattactgggaagttggtaagaggagaagagaagatgagattagtgataaaattacattgatttgagattagctcttataaaaagatcactggttgcttagtagaaaatgatactttatctcaatatcaatcagatactgtgttaaaatattctgacagtttagacaggtagaggctgtgtgggggaaacaaaatagacaaatttgagatatttgggaggtaagactgacaaaacttgatagtaaattaaatttggggcatgagagagaagattaaaatatagtttacttgtctccatatttgagtcatttccttatgctactaaataatatcagcagtcattgcttcaacaaatctccttaacatattttgcttgagttctatgctcactgtgtatgattttcagctctctgttcataataaatcatatttcatttaatgcttcttcacttgtctgtgaatgttacttgctttctttaaaaattaaatgtcaaaagataactgaac

SEQ ID NO: 727 - DNA, 1863 bp, Homo sapiens
tacagctgagggaggccgtgggagcctccctggactcatctctgcctctgtttctttattgattgttgcccagcaactctgatcttgttgctgttctgtttgggacccagacaatgcaagtggtggagggattttccttgtcaggtctttcaggctgaagtgtgggcacatttgattgtggtgaggggaacgcacagatgtattacaaaatcttagttgataaagcagtggaagggtttgagaggattgactccaattttgaaagaagttctactgtgggtaaaatgctatcagacagcatcatgtgttgcagagaaatctttcatggaaggaagagtccactgatgtggcaaacatcattgtcttattttaagaaattgccacaggcaccccaacgatgctgacttctgtcccagatgcagtcaccttcatgggggcggactccctgcttgtctaggcaatctcaaatggcaatttttgagtgaatggccccagcccacagctaacggcagcagcttgggcctctggccaggctggctgtgtgaccccgccaggccccggcccagctttctcactgacgtgtcaagaagggagagggtgagggtgtggggacttggggagggttggtggctgggcctaatcccactcctgtccccggatgacagtgccctagcagctcacggcagagtttctgggagccctggaagatgtcagcgcttgacctttgctggctgcgggggctcctactgctgtttgcggaagtccctaagtcagtggcaggagggtgagtaaaatgtcacccctgtgcaatgccacagtgctgaggatagtgctgagggcagtgctgaggacagtgttgaggctggtgcaatgccacagtgctgaagctggtagaatgtcacaaggttggggagaatgtggcagattccccaaacacacggaccagaagcatggtggccgcagaccatagcacaggtccctccgagggacagtgggactgcaccgggtgataacaagggctccattcccctacaaagaagtaatcaaatgctctgcctccatgtcggcaaagcaagcacttcccacccatgtcctccgtgaccaccaggaaggtgatggctccgaacagggcctccactcacgggttaccgaggtacctccacctgtgtcgtcagtgaccacaaggagtgatggctccgaacagggcctccactcacgggttaccgaggtacctccacctgtgtcgtcagtgaccacaaggagggtgatggctccgaacagggcctccactcacgggttaccgaggtacctccacctgtgtcgtcagtgaccacaaggagggtgatggctccgaacagggcctccactcatgggttaccgaggcacctgctgtcctttccagggttctgggacaaaacagcacatggacacttggatttaaattccagcaacaccatgatttcaggggctgttatttcagctcctgagcctgtgtttccttgtctgcagagtggggtgcacatggccaacctcacagagctgtgggctccatcaaggtggctgtcgctgtttccctctcagtgctcagcggcccccaggccacccctgcaaaattgctgcttcctcccaagaggtttgagcttggatcaaattcagaactccctggaaagggtggcatcaagaggccccctttccaggcatttgcattgattaaactctcgtgtgacctgtccatgactctagggagaggagcaacgggggtgatgaccgtgacaagctagagaccctcttggacagatggtcgttattccacttgctccaggcaccaccctgtgagtcacggcaggtgttggcatcccattt

SEQ ID NO: 728 - DNA, 1853 bp, Homo sapiens
atgagagactggatggctgttacaaacccaggtctgtcttcacaaagcaaaactatctctaagtatagctcagaagcaaagatatcaccaccaagtttatacttatagcaagtgtcatgttcctcaatagttttatttaaaaatgtgcacattttttgttggtgccttctgcataaatgataatatttaacagagtatttatgtcttgatccagaattgactacttttggctttcctcagttatgtgaaggatccaaaggtaaagagatagaaataattaaatatggcagctcttttaaattatatgaatgagctactactacttcagtagaaggatcttgtagctcaggaaacacagaacctggaactgggaggtgacatggaccatctacagaactgctaaatgaaacttaagaaactggaaacctccaagagggaaatgattgagcttcaggaaagagacagttacaatgcaagaacaggaatttgaatcagctattgaaaaatgagaaggataaggtacagaaattacgaaatattattgtaagttgagctattcagtattatcatgatatgatatgaaaagagtgtgaatataacaaactgaaggaaagtctacatcaaccttttatgaaccaaaaagaattaaaaatagctttagacattttaaataatgtggggagagctgatggaaaaagaggcctctggaaaactggtaagacagaagtcaggaatttgatgaaatgtataaaattatcttgaatgattatgagtattgtcacaaacaattcctaatggaaaatgctgataatgaagaagtttcttcaccaaatggaaaaggatatgttttttcttctttctcctcaaaagaaacctagagaaagagaagatggtagtacaggaactgttatctcagatgttgaagaagatgctggggaaatgagcagagacagtatctgggaactttcctgtgaaactgtgagagaacagcctacaaacagcatcagaaaacagtggggaattttgaaaagtcatggagaaaaacttggtagccacgtttcaaaggtacacttagaaaatttaatgatgaagatttaatctcaaaacaagaccatgaacaagaagctgaaaaactcaaattagaaattcagaaatgtaaagaaatgattaaaactcagcagcaacttttacagcaacacctcactactgcttgtgatgatgataccactgcactattataagactgttatttggaagaaaaaggatgccacaaaaaatggcccctttttaaagagcaaggagcaaaaaaataattttcagagagaaagacgaagctttacagaagcagctattcacctaggtttggagagaaacatgtttgcaaaaaaaaaaaaaaaaaaaaaaaaagaaaagaaaaaaaagagccagttgattaaagcaacagcttttagatatgactaccattgaccaccagaactcaaaaaatgttaaacttttcagtgtcttctgaggaagttctgatcaggacaatcttacggcgcactccaggcaatggaaaggaaacctcagagtgtgcataatggtctccagtttgcatgtctaaacttactgaatgtcttcttgcttcaccttctactgaagatttcttttcagatgcattcctgtgtatctgaacatacttcaataaacgtactgaatataactcctgaataaattgaaccaaatcatgttgaaagagaatctacaaacgagaaatgaagcatgacagcaagacctgcatcataggaagattaccatattacatgctccctgacccacacaatttctcatggagaaaaagatgacttacctta

SEQ ID NO: 729 - DNA, 3043 bp, Homo sapiens
gtgctcacacgcagctggcaatggcaagtcagtggatttaggataaaaccgagaataaggaactttacattgtcaatgatcaaacacctagtgcacccatggccgtgcgtccgcaggacaaagcagcctttggagccctggaacttaagatgtccagagatcagcagctctcggctcaggcccaggcagctggacagcacccagcgcctcctccaggtcctcctgggtcccctcctttctttcactttcagcccgggaatctctgtgaagtcctagctgataactaaggggttaatgaataatcacagtgatgagctctggaggagccatggcccagagcagctgtggcctcctttgattaaaccacagaagtccggaggatcaggcctcaaacctccaccacctgccagctggcacctgtgaaggaggtgggaccagcacccacctcacagtggctgcagggtcacctgagatggtgattgcaaagtgctgagccatcgggacacatatttccaagacctcctgagtgccggctggcccctggagcagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccaggtgagcaaggctggggaacaatggaggcggagccccgcgactgcccagctcactgcccccagtgtccaggctgtggtgcaggcgtggggacccaggtgtgttcaggggtctccttcagggaaggagaccaagctgggagtctggggaggctgaggtgtgaggtgacagcaggtaaagagtgagccacaatcagcattttcacatgaaaggaaactacaggcctgggcgcagtggctcacgcctgtaatcccggcactgtgggaggctgaggtgggaggatcacctgaggtcgggagttcgagaccagcctgaccaacatggagaaaccccatttctactaaaaaaaatacaaaattagctgggcatggtggcgcatgcctgtaatcctagctattcgggaggctgagacaggagaatcacttgaacccgggaggcggaggttatggagagccaagatcgcaccactgcaccccagcctgggcaacaagagtaaaactccgtctc

SEQ ID NO: 730 - DNA, 2035 bp, Homo sapiens
gccttcacgatcgtgatggcccgctggtcccacttctctgtctcaaactggctttttctcaatcctttgactccgccgggctttgtcacccccatgacctggtgttgggtctgatcaccccaacgttcctggctgctcaatgtggggtgacaaagaccccggtgaaggaacgctagagcgtgtgaaagcagaggacgcatcatcagaggacacctgaggatgtctaaaagaagctcagcaggaaagctgagtgctgggaagaaccagggtagcaatgggacaaagtgaaagcagacattctgcttatttaaatttcttaaggcgtttattatgaagaggggggagtgaaagttagtgctcagaatttatcactcttcagtgcagtaaagcagttttgcccatggttcccggaacaagggactatggagttggatgaatgggagagaattggcagagatttttaaaaaaacatataaaggtggagcaaatattccagtctcggtttggtcaatgtgggcactaataaaagcagctcttgagccatttcaaacagatcatgaggcagattcagatgaggaagaggagggcgagtgtaaaaaactaacttcagattctgaatgtgaggaacagaaaccggaggaaatcaaagaaagggaaaccgaaaaaggtatgttttactagcccctcagctccacctgctgaattaagtgaatggccacctcctctctctccccttagtgggcgagaaaatgaattagctacaaaacttaccgctcctgtagttgcaacattaaaacctggagcaattggtagtactaagacccagtggaatctgaggcttgtttatttagagagcacctcaataaactgaggcatatccggcacagccagtgcccttacaaacggcaacaattgtctcccaccgcggcgggcagtgctgccgtggacctttgcagcacagttctcatttccctgcttcctgggagccactggagagggtccccacgggagttgggggacccttgccctcaggaaccgtcggtctattacttgaaagatctagaggtggcactgtgcatacggaaatgattggttctgattataccagagaaattcaattagttattagttcctcaactctgtggtctgcttccccaggaaaaagaattgctcagttgttgacataaagctgggaagcagcacagtgagaagaacaggaggctttggtagtactaatccaacaggaaaggctgtattttgggttaatcaagtgtctgacaaaagacctatttgtacagtagacctgctgttggatgcttacagactgacacacaggcctggttggcagtagtctccggaaaaaataaatcatgcgctgctttgcgtagggcaagtcaagtcatcttgaagcttcagtttcatgtttaacctgcctctgctggagaaaaacagatttaataagcacacaggcatgatatgggctgaatgtgttcattgtggtgtttgtggcctttatgatgggaatgttcaacctctactactacattggtgcaaaacaaagtgaagccttcacaacagagttttaagacactgctctaggctatatttggactttctgaagtgaaatcagtggtcatcaactataaccacaaattcattgaaaacattggttatgttatttatggagcctataatgttacaatggtcattgttttgctaagtatgttaactgccatgatcaacaattcattccagggaattgaggatgatgctgatgtggagtggaaatctgcaagggccaaactctggtttccctgctttggggaggggagagcacttcctgttcccttcaatctggtgccaggtctggggtccctgttttgtctcttgctgaagcataaagggtggatttttcagctctacccagggtcataaaaaaggtttccaagaaagatgcagagataagtcagtaagtagagataagtaagtggagacaagaaagtagagacaaatagagacagagacaaatagagac

SEQ ID NO: 731 - DNA, 2414 bp, Homo sapiens
cttttcgcatatggagcagcaatcagcttacaactaaatcacatctgagcacaagctgtctccacaaagccaaccaaagaggcaacattcacaggctgacaaagcatccctaaagcaggaaagaaaagaagcccctgaggctgctgcccggagaaggaaaaggctttcaacattcataccagtctgttggggcattgtgcagaccacagagggagagtaactgatggaatactctctgaagttcacacttgggcgaagctgcatgtttaacatcaggagtgggaggaaagtttcactttccccaaccctccaatgccagaatccatcctctctgtgtgaactggaacgaggtgcactcagtcacgtaggatggtgactaatcaactcattacactttagagtaaatgattttcaataaattgcctcatccaaacatttctatcttaaaccattcatctctgctgctcaaagtttaatctgtttctaaaggaacttagacatctgcaagtagttgaggaaaacatttctgaaaataagaataatgtcattcatccaacacattttattataaagtttaccgttacagaatgaaatttgcccccttgaaaattcatatgctgaggccctgacccacaatgtgactccatttacagatagggtctttaaagaagtaattaaggttaaatgaggctataacagcgggcccctaatttgatagggctggtgtccttataagaagagaaaaagacaagagctcactcacttctgggcttacgtgctctctctctgagaacacacagaggaaaggctatgtggggacaccaagagaagacagctgtctgcaatccaagaggagaggccccaccagaaactgaccctgctggcacctagatcttggcatgtccagaactgtgagaaatttgtcttgtttaaaccacccagtccatggcattttattgtggtgccaggcagactaatacacttccttacctatttgtcaagcactgtgttagacagtagggatacaaaatcgagtaaagcagagcccttatttgctcagaattaatggcggtgaggaagatagagaagaggaggtgtgatcagtggcactactgattcatttgtctagcgtggtttaggcagtaccagaagggatggggcagacggtacacttctataaagtaagtcatgtttatctgtaacaattttttttttctgcttttttgagagggagtctctctcttgtcacccaggctggagtggagtggcaaaatctcggctcactgcagcctcctcctcccgggttcaagcaattctcctgcctcagcctcctgagtagctgttattacagatgcccgccaccatgcccagctaattcttgtatttttagtagagacaggatttcaccacgtaggccaggctagtctcaaactcctgacctcaggtgatccacccacctcggcctcccaaagtgctgggattacaggtgtgagccatcgtgctcggcacaaattttaaatattgtagaaacaatcatagtagactgaggctgggttggttaggcttcttttataagatagtgatttattttttaaaagaaacttttaaaagaaagcctcccacttagagataattagaatagcaaagcatttaaagaactagaaagattcttgggtagtctgggttagctgtaacacacaataagaccctcagtctttcactctgcccttcacactctccccaggaatccttctagtaatcttaactccctcatgataccactatctaccagttgctccagcaaaaaatccaacagtcaaactttatttctctctgtatttcattttgtacatctatgtcagcaacagatcccactgcttctaattccaaaatatatcataaaccgaactatctgtctccactgccacctcctcagcccaactacaatctgctctcagctagatttcattaaactctccaatgtctccaagctttcccaacaaatcgttctccctacaagagtgaaattaatcatttttaaaggatggacctctgtttacccttaaaacaaatgattatataatactgaatacacatatttaagaaaaatagagcagacatctatatagctactacacatttaaatctccttatgtgtctcttcccaattaactatgctgttcatcatcttccaactaacctgtacttgatatttattttactaacatacttcttttggttgtctaaatctatctctaagcaatatatattatttttgcatttttaaagtttggtgtaaatgatattttattgtatttattctttggcaatttgtttttatctcattattatgcttgtgacatttattctcgttcatttttgcttctgtataatattccacgttctgaataaac

SEQ ID NO: 732 - DNA, 1292 bp, Homo sapiens
tgggcgacagagcgggactctgtctcaaaaaagaaaaaagaagtgctcactccccagcctcaggagtggccatgtcaacccggggggcacagccacacaggcaagggcagccctgggttggcctcagcgtcatgcggcattgacactgggtggacatgcactggccggccacaggcctactatggcgggatgtggggattccaggtgaggggcatggatggtggacaagatagagagaggtttgggggttcctgtcagcaggccttgttgttgggcttgacatctgcagatcttcctttcaactcggacccactccagaccttgagatccccagggatcatgcagagtgaaagtgagcttgcgtcacccacctctccagtggactagagctcctcaggactaagatattctggcttcctccaggggaggaggtaggagaaaaatgaataagagggaaatgggaaggaagagaaggaagcaaactcccagaagaagtttgcatccaacggcaaaagaggcaacaaaaaattaccatcaatagctgagccaaagtagatctagttccttctgcatcccaagcatcacgctaggtaggtactctcacaaaacacggctcattttttttaaggtggattttattttactcatttaaacagctttattgaggtataaaccccacccacagagagaatatttctatcctcgcttttcaaataaaaccatgaggaacagagaagttgagcaacttccccaccattgcaaaggttttagataacggggcagagatttggtgcagaactgtgaagtctctgaactcccctcaccccactcacaataatgctcctgttacaacaaagaacgaagaaaacgagcgttcctgggatgaatccatattgctcctgtggagtaaaccatgactaggaatgcaagcggggctgaggcacatatctgcctctctctgatctaacccttgtcaaacaatgtgatttcctttccacaccagagtggagatcctttctctgccctatggctgcacacctgcagcctttgtccataatttgtacactttacttcctgaaaataccggcctgaaatagcaaagataagatggtgctccatctgggctctgtgtccatggaaatgtcggtttcctggctgacttcaccctgtccctgtagcccttgtctgtcattcctgttgggggccatgccctgctttggagtggtgtgtgtccctgttggcatggcttcctgagagctgtcactgaacctgggaatcagaagtaaacccaa

SEQ ID NO: 733 - DNA, 2613 bp, Homo sapiens
ccagccagatgctgtgaagtctccataaatctgtcagccgtcccagtgccgcgggcagtcacctgcggcgcccccttcccggcgctagagcggcccgcggagagacgcggagaagcaacgggaatctagcccggcagactgtacccgagggctgccgaagtcagacccaagcactacaggttgtgcggaacgcgaggacccctccctgtatccccaacctggaccgacccccggaagcctgctcctccgggtctacagggatgaaggtcagagtgtcaaattgcagattttggatcctcaataatgggccgctgtatttaacctcttcaacttcttttctccacttataagaaggaacaaaataaaatgttttgtggaagtttatattgaaatgaggtcaggtaaactaatgactgcttggtattttatgacaagttttataaccttggagttgccataactttcaaacgatcatcaataaagttttattgcaaaagggtcgccatgtgtctgaatgcttttgcacatagtaaagctatgctgccccattgtcgtagctcaccagccccttttcaccccagccataaagtcctcttcttttttattggaggttgaaaagtcctcgggtctgctctcctccatcaagttggcaatgtgggaacaacacagaaattaaactacatgattaaatgatcgtacacaaccaaatcttcaagaatatgtaataagactgctttttaataattataaatttggattttaaatgggttccatttaataaaataaatgacagtgggcggcgggtgggaaaggaggaagtcagatgagagtttcctccagaaacttgtgtttgaatgttagataagacctatcagtctacccgatatacccagagggctgccattaaataattaggtgcttagggaccgataatggtctcaagacaaaacaacgaattgctaaagactctttgagctgacccgaggatcttaaagatttaagaggcctcgcattgcgtcctaacttgaattttcccacggagggaagggttgggctacagctcatgcttgcccgattgctgcctaacacattccctaaacgctccctaaagccaaaccaagaacttcaagtgtccacttcacggcatcagctgtcaggttcaggttcgggtccgcctactccttgtccactgccgaatgctatgtggaaatgaagccgagaataatgtcctgcgatttagatgaagagaacagtaagaaaggtagtatgaaacgaagcttctactgacgcgcccttcagacaggtattccgcaggcgagggttgtgacccagggagagagtgcgggagtgctagcagagcggcgggagcggaaggagaggctggacgaaagttggaaaatcatcccatctcgggacttgagtgcgagagcccgccccggagtcggcaagtctccagggttagaaggccctagctccaaagttttttgtcccggctcaggcaggtcccccacctctaaccttccccgatttgcctggttgctctcggggaagggactggtaaataccgccctctcccggatttcctgaaactctcaccagcgcgctgaacccgctccttcccacgttcggcgccccgcactctgcgtctgcgcccactgcgcgtcaccttccctccggccgagaccactagagccctagatccgggatctgcggagggaacaggacctgagcccctgctggaccctgcaacttggctgcggagagcgcgcagccacaagcgccgttcctcacttgagggcttcgcgagagctggctcagccccgcgggtccccgccagtcctcgccagccctcgccagccccggtcggccccacgctaagtccgcagcaggcgggaaaccccgcaggccttcccggactcacgaactgcctactcccacccctaaagagctcagacctgaaggtgctcttatggtgcgtggccgcaaccccggagtggaatgggtggggggcctccatggcgaaggagacgccgtgggcgaatcggctcccagctcgcccctcatgtcctacaggtcactagccgagtccctaccccgggcgctcccatgaggcaccaagagcagccacggcccagggaagggcctgggtcttcactgctggagcgggccccagtcgagggcgcgcaggtgtcggggtccccagcaacctccgtatgcgcggaaagccgtaaacggggttctgaggccggcgccaggcacaaggatcaccccgcgccacgggccacggctcagagcgcccacgaagcccggctgccaggtccaggccgcggccgggcgggacccactcgctccccacggtgctggcgcggcgggagtcgggctggttaaggcgggaggccggcactgccacgggctgtggcgccccctcccgaagacacctcgccggaagtgcggctcccgcctggcaggcgctgagactcctcggctgtagcgcgaaggccccggtccgcgcaacttcccataataacgccgcgaaatgcctccagaaatgcctgtgtggtatggtgtctgagccaatggtcggcattcgtcttccccaagtgcggaaaagag

SEQ ID NO: 734 - DNA, 3348 bp, Homo sapiens
actacagcctcagtgcatggcggtgggcgcttccagtaactcaggggtgggacttttttcttgctcaggggatgaggccgagcccacaggcttagaaagaaggaacttgagtccgggcacctgtcatcccagcgcttagggaggccgaggcgggtggatcacctgaggtcaggagttcgagaccagcctggccaatatggcgaaacccccgtctctactaaaaatacaaaaattagccgagcatggtggcatgcacttccagctacttggaaggctgaggcgggagaatggcttgaacctgggaggcgagggttgcagtgagctgagatcgcaccactgcactccagcctgggtgacagagcgagacttcgtctcaaaaaaaaagaagaagaaagaaggaagctgaggttcagacaggctaagtccctactgcaggctgcggaatctaaaaaggtaggtgccagggtttgcaacccacacttttattttggtctcaggtagctgatgtcattccagtctatggcaaagaaggtggcaaatccattaacatagatgaagaatttcattttactttttagttttatttatttatttatttttattatgtatcatgcttttaatacaaactttaaaaaatctggaacaatagaaactgtacagatttgatcaatctttttgttttgtttttaaactaaaatctctaaacacaccaatgtcctattccaaaatattgcacaacattctgaatacaaaacccttgattgtattcctccttcactgaagaaaaaacttcatgaccctgctccccgggctcctctccaggcttgcgtcaatgcccccttcccatccctagggagaaaactagagaatctataactcactgcattgagaaaaagacatcattctggactaacagtttccattcttcagaagataatccaccttttgatttgttcctgggaaacagggatagatagaggatggggaaaggggagaaaaggttttatttctcctcttttttttttaaagtttgtttttcctgaaaaaatatgtttctctcatctttttaagaaaaaatcttgaaaagaaaaaaattgtttttacgttagaaatatacatatattatatatacctcttacattttacaaatgtagcaaattattcaatacaaacggacaccaaaaaatgtaaaaaataaaaaaaagttttcctaagaaccaggtaaattagtgcagatttctgtttttgttttcttaaaaaaaataaaattgaagcaaaagtgcctagatttgagacaagacagactgaactgggcccaagagcccagcactggagtcatgctcctgaacacacatttttcttcgtatttcaaaagacacaaaggggttggtctccccccctctccctacatgtgagaaacaagcagacctggtgtgggtgggtgcctgtgtgtgtggatgggaggagggatagaaggggatgtaaggcagcatccaacctttcccagagagaagctatctgctgggcctgtcacctgtgtgggagccgaggatgagggaaagggtggcccagactgggctggcccctgagaagtctaggggaacagatggtgctgggctgagaagccaggacattgcctgccgggggaggtagagctggtgcctactgcagggagaggaggctggcagtgccggcctgggctggacccactgccatagcagttgcctacttggggtccctgggtaggatggagtgggtggggtgccaggggctttggtgctttctggtgatgggaccctgatgccaagtgcccactttgcaaagatgaaaaagttcatgaccctgctcccttggctcctgtccatgcttgcctggcctcctggggttggaggaacaagctctctcctggcagaggcaggagagagttttattttttagaaacagtttcgctttgttgcacaggctggagtgcagtggtacaatcacggctcactgcatcctcgacctccccaactctagtgatcctcccatcttagcctcctgagtagctgagattgcaggcatgtgccaccacactggctaacttttttttaacttttattttttgtagagatgaggtgtcgctatgttgccctggctagtcttgaactccaatccttccacctcggccttaaataattttaatagttgacatgcacatggcatttactattggccggcattattttaaggtgcctgctctgaaggaattctgttagccttcctaaattattcccttggccattggaaacataggcatgagatcatttttagataattggaaaagcagagaaatctgtgaagatagaatgggaaaaaaaatgcatttcactaaaccaacatgccattgattgtgagattccacattactttatgtagccccacggctgcccttaaaccatgacacatgctttatttacagttcatattttacttattcgtagacctcaagaggcattctgtgcttccctcttccttctggaagcttcatgagaagggacattttcctcaaaggatggacaacagaaacaactcaaatattcatttcctttaaatatggtttttaagacaattttctttagaaagccacatttacctgttgggggttgatttatgctcacccccctcccaaatatatgttggaatgctaaccccctattcctcagaatgtgactttatttggagacaggttctttacagaggtaataaagttaaaatgagtaaatagggtgggccataacccaaaatgacagctgtccttataaaaagggtgcatttgcacgcagagacacgcatagagagaacatgatatgtagaggcacagggagaaggccgccatctgcaaaccagggagagaggcctggagcaaattcttcttcatggctcttagaaggaaccatccctgcctacaccctgatttcagatttccagcctccagaagcgtgaggcgataaatgtctgttgctgcagccacaggttggcggtgctttgctgcagtagccttagcacctgatagatggtctctttacatgtcaagcacattgcagcgcacatttgacacacagggagatggaagctcctggaggataagtgttttgtctgtgattttgaaggttgcaagtggaggaactgggattcgaacccctctctgtgtgatgcctatgcctcctctgtgttaacatttatttttacttatttttattttttagtttttgtagagatgagggtctcactatattgcccaggctggtcttgaactcctgggcccaaacgatcctcctgccttggcctcctggtcttgggattaca

SEQ ID NO: 735 - DNA, 12765 bp, Homo sapiens
ctcttgaatacctcatcaacaccgcaggtgacccggagcccgctgctccgctcggccccgccccgggcagctatttggcacatttcaattagcgtaacgggtgcctggtaaacagccgaggccggctgcgggcacctgcaatccccgacccccgacgccctccccgagaccctggagacgcggctccgcccccaccggtaattaggagattttcaaggcctatgtccccaaagcccagcccagctggagagatcagccctgcggtcctgccgcgcactccaccgccagcctctcgggagtcaagggatccgccttcagggtgaattggggttccaccatgtcaccctcatggagctttcgttagccttgtttgggatacaaaggggtaagtgtcccctcattttagagaaagatcaagagccagtgaacaggatttcccagccagggacatggagcagggcacctgcagatggtccacgtgctcttggctgatggcagcccacctccgggaggggcctgtgcacctttctcccaggaggagggaaggacccaatcattatccagagtcaacggtcctccccatgctttccggctgtaccctcatcctcaggacgaacctccgcacctcctcccatcatctcaggccccatctgcaaagttgggatcagagagaggcccagactgcgctggacaactgagccagttttcatttcaaatcgaagtttaaaagatgccacttttaattatgcttgagtgcagtgtaccctgaggccttttgtggtaaatggctctcaataatcccagtttattcattaattattattaattattttcttaagtagtggcaaggggacgcagggccccgctcagaccacaagtcgcacatcgactgtcaaatcctcgatgagcaggctctgaagagttgcctgtgccggctgcaatctggctcgcctgggcccgggctggggtgccaggagcactctggactgaggcggggcttccagagcgtggggcagggctgggggaaaggagggcctggaggagccacaggccacaccggacaaaaacaccttccaccagggtggcacttcaccttcgggaagctccttcactggataatgaagacttttgtcttcagcaaagcgaggaagaaaagaattaccattaccaccagccaaggcacctgacacatgtggtcagtggtgaactggtaaactcgttctccagaaacaaaacaatcatctcaatcatctaacatttctttcctcttttttttttttttttttgatacaggatcttactctgtcacccaggctggagtgcagtggcgcaatcttggctcactgcagcctcaaccttccaggctcaagtgatcttcccacctcagcctcttaagtacctgggactacaggcgcacaccaccatacctgcctaatttttgtattttttgtagagatggggtttcgccatgttgcccaagctggtctcaaactcctgagctcaagtgatcctcccacctcggtcttgaggcttgagccactgcacctggcctaccatttcattatttatgattctataatattccactgtaggggcatacaggtcccttaacttctcagttccttactactgggccatttcccacttttcattattctaaacaaatttgatgaacaggcttttgcataggtatctacccataccctcattcacttacctaggtgacatttctaaaggtgaaattaactgatcaaaggacgtgtgtttttaaggctttgatgcacattacttaactttaactaaactcaggaaaaacggtgataaattataccccaaggccagcacttgggaagctgagatgggtggatcacttgaggtcaggagttggagaccagcctggccaacatggtaaaaccccatctccactaaaaatacaaaaattaatgggtgtgttggcatgtgtctgtaatcccagctactagggaggctgaggcaagggaatcgcttgaacccagaaggcggaggctgcagtgagccaagatcacagcactgcattccatcctgggcaatagagtgagactcggtctcaaaaaaaaaaaaaaaaaaatacacacacacacacacacacaccccaaggatagatatttataggggatcacactgatctttatatacgaggtctagaacaaggcaaaatgcaaataagaaaaagtcctgaattctagtacttgccagtttccatggtgtaatactcccatcctggccagtatggagatactaacaatttaacaactggcttgcaaaattcctgaaaatctaacaaccgtctctgggagctcatgggagctgaccctggcaccttagtgtgtgtgatgagatttcctccttctctgaaaggaggtcatggtaatttcatctgtcaacttgactgggccatggggtgctaaggtgctggtcaaacattctgggtgtttctctgagagtgtttctggatgagattaacatttgaaggcttggtgcagtggctcatgcctgtaatcccagcactttgggaggccaaggcggccagatcgcttgagctgaggagttcgagaccagcctgggcaacacgacaaaccccatctctactaaaaatacaacaattagctgggcgtggaggcgcatacctgtagtcccagctacctgggaggctgaggtgggaggatcacttgagcctaggaagttgaggctgcagtaagccgtgctcacaccagtgcactccagcctgggcaacagagtgagaccctgtctcaaaaaaaaaaaaaaagaagcgaaagagggaggcaggagagtcagcatcagaggaatgagatacaggaaggagtcgactggtcattgctggctctaaagatgcaggaaggggtcgagaaccagggagtgcaggcagcctctagaaaacagaagaggaagaaaatggattctcccacagagcctccaggaggcaagcaggcagccctgccgacacattgattttagcccagtgagggccgttccggacttctgatgttcaggactaagatatattgtgttattttatgccactaaatttgtggccatttgtttccaagacggtggtattgtccccatttaaccaggtgatggaacaaaatttcagagacataaactctgtgggtcacagctagtgatgggggcccaaaacagggtttgaccccagggctgtctgactccatggcccacgttctttgttgtatcccagaagagaagccactgtttacacgaaagcacctctgggaaggttaacaacttcgtcctgtgtcaggcacgggaactgcgtagcctttcttcatgaaacaccagaaaataaaagaaaccggccggacacggtggctctgtcaccctaggactttgggaggccaaggcgggcagatcagttgaggtcaggagtgtgagatcagcatggacaacatggcaaaaccctgtctctactaaaaatacaaaaaaaaaaaaatagccaggagtggtggtgggtgcctgtaaccccagctacgcgacaggctgaggcaggagaattgcttgaacccaggaggtggaggttgcagtgatccaggatcgcgccactgccctccagcctgggtgacagagcacaagactcagtcaagagaagagaagaaaagcggaggggaggagagggggagaagaagagaaaggaaagggaagaagagaaaggaaggaaaggaaaggaaaggaacaaccacaagcatccacatccagcttaaggcagagatgagtttgcaggaaggaggggaagcccaagggccggagtgaaccaggagctgaaaaccagacggtggctgcgtgagtgtggccagcgcaggccgaggcttcctggtcctggggtccagggcttggactctgactcctccacggagatgagaggtgtggcctgggggatggacatgcagaatcgagacccctgcataaagccaggccccttcagttctgcggtctccgtggaaggacagagcaaaaacacccatccccagcacagggagattgggagagggtctgtcactatgggagaaggaagatcagagatattggcagagcggtctccagaactgattaaaatcaggcaccagcagattcaggaagcccacttgagtcctcagcaggccccagccctggacacaggggctcaggacacagccactactagacaggagactgtaccctccgggcctagtgccttaccaagcactgctcctgggagaatgtttgctgaacggatggtgatggggagagggaaaagagaggggaaagtgagggtgtctaagtccagcttgagacaaggccgggggattcatagtctccacccaccctctgccttcagaggtccaaggatggggtgggcaccagcatggggctgggggagccatgggggccaggggtatctgctgtgggctcaaggagccctcccagggctcagaccccagcctgaaactctcccagcactccaaaagccaaatcccacccagctctgggctgcttcatggggccccagactggagaagacaccccacgaagggtctctaaggaagaggcgctggtggtcaggcctgggcagctgtgggagctgagagtttaatggggagaacgtgctctgttggcttcacgctccaacatcagggggaaccagctgcaccgtttccccagaatcacggtctcttgagcccaatattcaaatatatgcagacgtcggagcctggactatttttagctgagactcagagggagatgatctcaggctgactcggagagtggcccagtcccagaggagcgcagaatcaacctgaaaagtcaggcttggggaccacccccttctcctgctgtaagcgcctggattctgcaccccaggtgccctgaaggtctgtgttgtgggtgtttatttggggcggagggactggtctgcatccctggggagctgtgttctctttccttcgatgccttttttcagcaaacactttgcttttctgcgaaaagacaaagcgggctgcatgctggagccagcggcctggctagggggccgtttacctcccgactcgggatgcgtggctcagcctcttattatcttgaaaggcagcagaagtctgaccccttctgtgtgagcttcccatggctgttatagtcacttaccaccggctgtggcttaaaaccgcgggagcgtatttcctcacagttctagaggccagaagtccagcatcagggtgccagcagggccgtattccctctgaaggcgccagagaagggtccatctttgccctcccagcttccggcggtcaccagcaggccttagtgtttgctggcgcagctgcatggctctgatctctgcctctgtcttcacagggatttcttccctgtgtgtccccgggtcctcttctgataaggacaccagtcattggacttaaggcctctgctaatccagtctggcctcatctcaaattgaagaacatctgcacacaccctatttccaagtaagatcctattcacaggcaccaggggtgccttcaatgcatcttttggggggaacacaattcaacccacagcatcttctgtgttgttctgcccaaggacagccaccccccagcagccgcggtgagaagttcccccaggtttggggtttccaatcttgggtggcggcaggctgggagccagggaccgcttgagccttactgtgctctcctgctaggaggggcggcagctccttgcccctggagacagcgcggctccccagagcagctgagtgtcttgcagtcatcaacagccacctcatctcagaggcagcacctggaatcttacctgcctcacctcctttagtcctcaaaacacctgtgtcccaggattatgtcccttattctacagaggaggaagctgaagtgcaaactaagaggaagttccgaagcagcaggttggggtgccaggtgccagcctggtgaggagctcggggctctcgcgaggaccgtgacggggctttcaccccatcttcccttctgagtcgggcttgttgggatggggtggtggggtctgcacctgcacagccaaggaggagcagggcagcctcaccctagcacagtcctgaaaagagggccccgccccctttaagggaatacgtgattcccttttagagagtgctaggccgatacttggaggagccagtgtggtcgggcagaaaggggtggacaaacctaaaccctacggacctcttttttgagaccccaaactgcctgggctcttgcctcccagaagtcagatcttccccaggggagggtgtgggaaggtggggttagggaacatacagggtctttgggagccttctaagtcagccaaggcagctggggcagctgcagggccagagcacagggaaggcaggtccccaggtctagctgctcggcctccagccccgccaggcccagctaagagggtgctttggctgccaagagaagaacccagggtggggactgcctcctggacctccacaggcagctggcctcctacagtcctgctgggacctgggaccccgtcctctctgctgcccttcagcttccctggctgtgagggacagaacttgttaccagcctcccactcatgttatttctcctgcccttgaacttcaggactgtcttggagccagccgaggcctgtttgcatcctttgcccccaggtccagctggatcccccaccttttcctccactggattcagcctagtgggccctgggctgcaagagaagttgcttcagcccaggggctggggctggaggccaaggcttcaaatgaggcctccccaagttggtactcaacctcctctccctccttggagggcaaagccatgagggctgcagagaggagctagccaggtatgatgggtaagtgcagtggttcacagtagaaccacactagacacatagaggagtgctttatgaaatgctgatgcccagctgggtgcggtggctcacgcctgtaatcccagcacttggggaggccgaggtgggaggatcacttgagcctaggagtttaagacaagtctgggcaacatagtgagacgcccccccacccccatctctataaaaaaaattagccaggtttggtgacgcatgcctgtggtcccagctactcaggaagctgaggtgggaagattgcttgagcccagaagtttgagggctccagcctgggtgacagagtgagaccctgactctaaaaataggaaattttttttttttgagatggagcctcaacctccacctcctgggctcaagcgattctcctgcctcagcctgccgagtagctgggattataggcgcgcaccaccatgcccagctaatttttgtatttttagtacagacggggtttcaccatgttggccaggctggtctcgaacccctgatttcaaatgatctgcctacgtcggcctcccaaagttctgggattacaggcatgagccgccctgcctagatattttggtttttggtttaattggctcaggtgagtccatgggctgaggggcttcatcacacctgtttcctcacctgtgagtggggaggggtggtcacctggcagggcggtggtgaggccggcccgtgcctgcccttccctccactgttcagagttgggccagggctgaaggaggcgtggccagcttcagaggaaggtgtgggagccgcagctctgcctggcactgacatctgggctgcaaattctttctaattctcaacttctcccccactactgccagccagccccttcagcttcatttaaaagttcagacaggattcaaaagtaggttgatatataaagacctattaaaactcaatactaagaaaacaactcaattaaaaaatgggcaaaagacctgaacagacacttcgccaaagacgatacacagatggcaaatatatatgtcacgtcatatgtcatcagggaaatgcaaattaaaacagcaatgagataccactgcacatctatcagaatggcccaaatccaaaacactgacaaccccaaatgctggtgaggctgtggagcaacaggaattctcattcagggctggtaatacaaaatgctatagccacttgggaagacagcttggcagtttcttacaaagctaaacatacttttaccatacgatccagcaatcgtgttccttggcatttacccgaattagttgttggaaattgtgtccaggagcttctggacagctgaacatgtggaggttcctgggaggtggccgtccagggagggcacggaagttccgtgtcctccgcccccttcatacctcaccctacgcatctcttcatctctactctttgtaaaatcctttacaataaaccggtaaacctaagtatggccatgtgactaagctctggccaatggagcacaatcagaagcagcatgagctgactccccctctcctttttctctttcattggatggaatgaggccttagaggggacccatcttggaccggatgaggacaacagtccagaaatgctggaagaccaagctgcatctttggcagattatattttccaaagatagaggcaacactatatcccattccacgagcacttcttctgctgtgactttgacacccctcccattgaggggtggcatctatgtcccctcctcatgagctgcagcaggaggagctttgtgactctcttgaccaatagagtatgccagcattgacagcatgtggcttccaaggctagttcaaaaaaatgcctttcacttccaccttattctcctgggatgttcactcttggaacccagccaccatgctgcacggaagcacaagagtccttggaaaggcctacatggatgggaaccatggcccccagcccaaatcccctgctgagctccccagccgacagcaccaacttgccagccacatgagtgagctgtcctggaagtgattctccagccttggggcaagccacctcagctgatgccatgtgaagcagagacaaattacctccaccaggccctgcccaaattgcagatctgtgagcaaaacaaatgactgtgactgttataagcagaaaagaaaatagaaaagaaaatggattccactcaaaaacttggaagtgaacatttatagcagctttattcagaactgccaaaacttggaggcaaccaagatgtccttcagtaggtgaatttgtaaacaaactgtgatccatccagacaatggaatattattcagtgctaaatggaaatgaggcaccgggccacgagaagatgcagaggaatgttagatgcatgttacgaggtactagggggaaaggagccaatctgagaaggctacaaactgtagggctccaactacctgatgatctggaaaaggtgagactacggagatggtcggaagatcatggttttccagggttaggaggaggcagagatgtacaggggtagcacagaggatttttagggcaatggaaccactctgtatggtgccataatagtggatacatctcattaaagatttgtcaaaacacgtagaatacacggcaccaggagtgagccctaatgtgaactgtgtttggttgatgatacgtcagtgtaggctcatagattggaacacatggaccactctggtaggggatgtggatggtgggggtggcctgtgtatgtgggggaggtggcatatgggaaatctactttccacccaactttgctgtgaacataaaactgctcaaaaaaatagtctttttttttttttttggagacagggcctcactctcactcaggctagagggcggtggtgcggcatgatcacagctcactgcagcctggacctcccgggctcaagtgatcaagcgatcctcccacctcagtctcccaagtagctgagaccaccggcacttgccacactagctaatttttaaataatttttgtaggccgggcgccctgggtcgtgcctgtaatcctagcactgggaggccgaggtgggtggatcacctaaggtcaggagtttgaaaccagtctggttaacatggcgaaaccctgtctctactaaaaatacaaaaattagctgggcgtggtagcaggtgcctgtaatcccagtaatcccagctactcgggaggctgaggcaggagaattgcttgaacctgggaggcgggggttgcagtgagccaagatcacaccactgtactccagcctggatgacagactccatctcaaaaaaataaaaataataacaatttttgtagagatgggttcttgccatgttgcttgaactcctgggcttaagtgatccttctacctcagattcttccaccttggcctccaaaaacgctgagacaacaggcgtgaaccaccgcacctggccttttttttcttttttcccctaactaggctcagttcctaaaagaaggccttggtcaggtttctgagccctacccccctcctgctggacaagatcatggaaaatgcctggctcagctattcttttctcagcctcttttaagcagcatagcagagagggacagaggtagagacagagagggactgagatctgggctcttcctccagctgtacgatatggaccaggcccctgttctcttcgggcctccatctgtaaaatgaggggacaggaggaattctgatggcctgtggctttgatctctgtgagcagatttggttgtatgaggtctctcccctggcattacatgctggaacagaagaaaatggccatagtcactgttaattaaaaactggtaccaagttattggtactctcacgtttgaaatacctactagtacctgcttggtctagaccagctgttctcaaagtatgggccctggccccctgtagtagtagcagcagcacccagaggttttttctgtttttgtttttgtttagagagatgaggtctgtgttacccaggctggtctctaactcaagcatcggcctcccaagtgctgggattacaggtgtgagccaccatgcctggcctttttctttctttttcttttttctttttttttttttttgagacaaggtcttgctctttgcccaagctacagtgcagtggcacaatcatggttcactgcagcctcaaactcctaggctcaaaccatcctcccacctcagcctcccgagtagctgggaacacaggcgcatgccacaaaccttggcctttttttttttttttttgtagaaacgaggtctcattacgttgcccaagctcgtctcagactcctgggctcaagcaagcctcccgcccacctggagcttattaaagactcaaatcccagggcccaaccccagatctgctgaatcagaaactccgcaggtgggggccagcaacatgtgtttcagtaagctcaggaatcaggtgattctgatgcatgccaaaattttagaaccactggcctggaacagggtgtgtgaagcttggcgctgctgatgctccaggccagatcatcctacgtggtatggctgtcctgtgcactggaggatgctgccagcatccttggactctaccccactggaggccaatagcatgccacccctgtctcaagtcacaacaatccaaaacagtgccagctgtcctccagggaacaaaactgccccagtggagaacccttggtgggaaggaaggccctgattgtgcagtgactcaaatacaggatcacataaaacctggagcgaaggcctggcgcagtggctcatgcctgtaatcccagcacttttggtggccgaggtgagtggatcacctgacgtccggagtttgagaccagcctggctaacatggtgaaaccccgtctctactaaaaatacaaaaagtagccgggtgtggtggcacacgcctgtagtcccagctactcgggagcctgaggcaggagaatcgcttgaacccagtaggcagaggttacagtgagccgagattgtgctactgcactccagcctgggtgacaaagcgagactccgtctcaaaaaaaaaaaaaaaaaaaagcctggagcgaagacgtgcatgcagggtcaccatgccaggctgtcactctatccagccatttgctcctcaccatgacttgaaaatgatccccattttatagcaaatcccacctccctgcttacaagctgtgtgacctcgggcaagttacttgaactctctgtgcctctcgctgtaaaatggaaatattaacataatagtacttacctgctagggtagctgagtgcttgaaatgacaactcaagcatggaacaaactctcagcccagtgcccgaggaggtaaacaccggctcattttctcattatgtggctcaggctcttagcaaaatggatttgtgttctctgacctcgtgcggccactgtcacagccagctggaggtaggcagaggccagcctgaggtgaacatgactgagttcaccactgcttgtcagggtgcctgcagtcacggctctggggcagccaggagatgaccctgggtcactgccaccagcagggacttcctttgggcggcttggagcagacagcacccagctctgcagacctgagcaccccatgtgccccaagtgacatggagcagaacccggggaccccggctgtctgccctccaccctgggcgagctccggatgccgcaggaaaagacgagaatccagcacagttcctcttctgcacctcacatcccaataaaatatttattatttcaagaaataaatctttaaaaaaaagagagaaaaagagtgtctctattgctttccc

SEQ ID NO: 736 - DNA, 2468 bp, Homo sapiens
ttttatcttggtagcaaggtagcaagacttttccaatgcaggaagcttcagtgctttcatttatattctgatgtaagttatcttattgcagaccggtaacaaacactgtcttcacagccatttgagccttaggtatgaatggagcagctttgggtggagggatatctccatgactgggtgggaaaaggtccagaaagacaacattggagtcaccaaatactaactgttcactaggcttggctgttataaaagctgccaaaattcatgcttatggtttgactggatttcttttctctgcttagtatgcccttcagtagaagtgccaaaaaaaaaaaaaaaaagacaaacccagttatatagcccaaagaagaggattaagttagttatctgcagcctctggattgactgtgaagtctgtttgaaaatgggagtgttggccagtaaaatgtttccctaaaaaactcgaagctgaggccgggcgcagtgtctcacgcctgtaatcccagcactttgggaggctgaagcgggtggatcatgaggtcaggagatcgagaccatcctggctaacacagtgaaaccccgtctctactaaaaatacaaagaattagctgggcgtggtggcaggcgcctgtagtcccagctactcgggaggctgaggcaggagaatgccgtgaacccggcaggcggagcttgcagtgagcccagatagcgccactgcactccagcctgggtaacagagcaagactccgtctcaaaaaaaaagaaaaaacaaaacttgaagctgagtgtttctggggactctcatgagcatttttgaccatcaatttagaagaaatattctgatattactattgcattaccattattttatctagattaaattgcttcatttcttaaatggttcagtctaaatgggaagacttgataataaacaaataataactaaaaggattagaaagattctatgattctagaattctttcaagtacacagttattttagagatccacttccagtatttattcacttcattcaacaaatattaagtgcacacctcctatgtgccacacaatgtaccagggctacatggtatacaatgatcaataggagacatggtcccttatggtgtttgtaatgtagtgggggagatataagcaattaaatccaagtcaatgtatgaataaatatataacaatgaatcgtgaacctcatacgaaatgaaaaggcaaatagttaataattgtcagacataaatttcagttcagttgaattcagcaaatggtttttgagcatctattttgtgccaggcactgtgcttagtattaaggatacagagatgcataggagaacattcttgtcctcagatccacttggcactatacctgagtaacacctacgcctctcctcaactcccatttgattttgttggttgatttgtgtaggtttggctatttcacctgctgttcattccacactcttagtgtgtaacagtgaggtagggctttctggtacctgtttgtctgcagatgtagaatcaactcttgtgtttgtgaatttgactcagagaaaatatttaaatgatttgacctttgagatgcccagctgagctgctgagcggacacagactcaacagaactaagaattgttgaacatctatcataaaattataggcttagattcaaagtgatcacaggatatgctcatttcttcccttcccttcccttccctccctcccttccttccttccttccctttcttccttccttcctttctctcttttctctttttctctttctctctatttttctctctttccttcctttctttccttccttttctttctttttttttttagctttgctttgctttcttctttctcagggtctccctatgttgcccaggctagactcaaacctctgggctcaagcaatgcccctgtctcagcctcttaagtagctgggactacaggcatgcaccaccatgcccagtttgctcatttatttattgtatctgggagtcttccacatgctaggcactgttctaggcacggggtaatagcagtgaacaaaacagacacacaccccctcccctcatgcaacttgcacctcacccaacgtttaacatatcctgacagtcggtcattcctttcaacttaaacatcttcactatcagagaactcatctccttatggggagttgtctcatttttaaacagtttgaaatattggaaagctctttattatactgatcccaaatccttttccctgtagcttttacctgctagtctgactaaggttctatatttgaaccagtttggaaatagctaatccttctttctgggaacccttcaaatatttgaaaaaaatacttgtgtttcttttaaggctccccattttgttagctgatatagagaaatatgtgtagatacacgagtacttggatatcatctaataaagcaattgcacctcg

SEQ ID NO: 737 - DNA, 2470 bp, Homo sapiens
ttttatcttggtagcaaggtagcaagacttttccaatgcaggaagcttcagtgctttcatttatattctgatgtaagttatcttattgcagaccggtaacaaacactgtcttcacagccatttgagccttaggtatgaatggagcagctttgggtggagggatatctccatgactgggtgggaaaaggtccagaaagacaacattggagtcaccaaatactaactgttcactaggcttggctgttataaaagctgccaaaattcatgcttatggtttgactggatttcttttctctgcttagtatgcccttcagtagaagtgccaaaaaaaaaaaaaaaaagacaaacccagttatatagcccaaagaagaggattaagttagttatctgcagcctctggattgactgtgaagtctgtttgaaaatgggagtgttggccagtaaaatgtttccctaaaaaactcgaagctgaggccgggcgcagtgtctcacgcctgtaatcccagcactttgggaggctgaagcgggtggatcatgaggtcaggagatcgagaccatcctggctaacacagtgaaaccccgtctctactaaaaatacaaagaattagctgggcgtggtggcaggcgcctgtagtcccagctactcgggaggctgaggcaggagaatgccgtgaacccggcaggcggagcttgcagtgagcccagatagcgccactgcactccagcctgggtaacagagcaagactccgtctcaaaaaaaaagaaaaaacaaaacttgaagctgagtgtttctggggactctcatgagcatttttgaccatcaatttagaagaaatattctgatattactattgcattaccattattttatctagattaaattgcttcatttcttaaatggttcagtctaaatgggaagacttgataataaacaaataataactaaaaggattagaaagattctatgattctagaattctttcaagtacacagttattttagagatccacttccagtatttattcacttcattcaacaaatattaagtgcacacctcctatgtgccacacaatgtaccagggctacatggtatacaatgatcaataggagacatggtcccttatggtgtttgtaatgtagtgggggagatataagcaattaaatccaagtcaatgtatgaataaatatataacaatgaatcgtgaacctcatacgaaatgaaaaggcaaatagttaataattgtcagacataaatttcagttcagttgaattcagcaaatggtttttgagcatctattttgtgccaggcactgtgcttagtattaaggatacagagatgcataggagaacattcttgtcctcagatccacttggcactatacctgagtaacacctacgcctctcctcaactcccatttgattttgttggttgatttgtgtaggtttggctatttcacctgctgttcattccacactcttagtgtgtaacagtgaggtagggctttctggtacctgtttgtctgcagatgtagaatcaactcttgtgtttgtgaatttgactcagagaaaatatttaaatgatttgacctttgagatgcccagctgagctgctgagcggacacagactcaacagaactaagaattgttgaacatctatcataaaattataggcttagattcaaagtgatcacaggatatgctcatttcttcccttcccttcccttccctccctcccttccttccttccttccctttcttccttccttcctttctctcttttctctttttctctttctctctatttttctctctttccttcctttctttccttccttttctttctttttttttttagctttgctttgctttcttctttctcagggtctccctatgttgcccaggctagactcaaacctctgggctcaagcaatgcccctgtctcagcctcttaagtagctgggactacaggcatgcaccaccatgcccagtttgctcatttatttattgtatctgggagtcttccacatgctaggcactgttctaggcacggggtaatagcagtgaacaaaacagacacacaccccctcccctcatgcaacttgcacctcacccaacgtttaacatatcctgacagtcggtcattcctttcaacttaaacatcttcactatcagagaactcatctccttatggggagttgtctcatttttaaacagtttgaaatattggaaagctctttattatactgatcccaaatccttttccctgtagcttttacctgctagtctgactaaggttctatatttgaaccagtttggaaatagctaatccttctttctgggaacccttcaaatatttgaaaaaaatacttgtgtttcttttaaggctccccattttgttagctgatatagagaaatatgtgtagatacacgagtacttggatatcatctaataaagcaattgcacctcgaa

SEQ ID NO: 738 - DNA, 9223 bp, Homo sapiens
agggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagggaaagaatggacattgacggcagagagcaagtttagcctggagaggaggaattgagtgagcaaagggggtagtctggggtgcgatgcacagaaaggcccgtccagggtaaccttcacgtctccgtatccgttgctgtcgactttccagagcctttgttcccagtgacgtccctattgcaatggagggacacacttcactttccccagccccccacctcgagaatttctctcaccctcccaccctgcggggccgcagagcttgctcctcacggcaggagttggagccctgacgcttgccttcacctagtttttgtttggtttggtttggcgttgatgggacaaagtcagccaaactactttgccatcagcagagaaggaaagctttgaggctctgcttggcaatgtatacaagacaccctccagagggatggcagctgtagtaacgtacaggaaaggggtcctgatccagaccccatgaaagtgttcttggatctcacgcaagaaagaatttagagcaaatccacagtgcaaagcaaaagtaagtttattaagtaaagtggtgaaagaacagctactccatagacagagtagtacttcccgaaagtaaaaggaggaacacgtccaccctaggtataatgcttttgtgtgtgtgtgtgtgtgtgtatgtgtatatatatgataaaacaatatcatggtgagatgtgctctgctacaagggtttgtgataaaggattaattttcttaattacatttcacaagaataaatattattatctttaaagcaaaattaggaatgcttttgttctcaagataccaggatattaggacactcccaagtctgggtctgttgaataaacattatcaatctgttcccttaactgcaaacatctagaggctagaaatacctttctttctgggatgcagcccagcaagtcccagcctcattttccctgccctcactcaagatggagtcgctctagtttgaactcctctgacattaagaggtggatttatagatttactaggatgttaatgaagcttaatctccaggacttgtcacttgcactagcccattctaagacttgttgtgttcttggggtaaccacggaagaagcactgaccctagccatgcacaggcagcatgaagtacaaagtattgcccaggctgggagtcaccctctataatctggccagtggtacagggactgcagtaggactagtaggctgtcaacaatacctccatatcagctgagctccaacacacaacctgagcctcaggactcaatctttgaccttaagagaaaggaacaaggacatgcctccctgcctgtaggccgctatgaccaaggattaaagataattttttcttcctctcactcctcttctaaggtactgcccagtaggaacaggaggcagcaaagacctaacaaaagtggaccatatacatagtagcagccatcggtgtccataagccgtgatatcaaagagctggagttttcccacttcttttccgagcactgcctgaaccagaaactcagatgtgacattaccagtaatgagtggtgaagcttcaagaaagctttctgaactttccttttccatccattgtgctagagagaaaactgaattatattttcaatctctctagagaaaatgttacaaaatttttcatatgaggagataatcaaagtgtacaacccaaaaatgtagaaaacaattgttacagaggtgaaaggcagttaattaataacttatttttctggattttgtgatgtttgtgctattcatgtgctttttaaaaaacgttgtattttgcgatttcctcattttcatagctaattttgcattcataatttcatgttctttttcttaaacaaggcctacccatctagctctggtctgtccaacacaagctgatctctggctcccatttgggctgttacgtattgaaggctaacctttctgggacagacgcagaaggcacatctcatctttatgaggtccaagttaattaaatcaattgatcataaatgtaaaggtttatatctgaactctcaagtctctttcattgatctgtgccaattcctgtgccaatatcacactttctcaattcctgtggctttatagtaaattttgaaatcaaatgtgtaagtccatcagtgtcagtctttttattcagaattattttggctactctatgtcttctgcatttccccataaattctagaatcagcaagtcaatttctataaaaattcctattgggattttgatagagattgaatggaatttgtagatccatttggagatatctgccatcttgaccatatttagctttcaatcaataaatacaaaatacatctccaggtatttagatatcttttgatatctctcagcaatattttatagttttcagtgtacaggccttacccttcttttgtaaaatttatttctaaaagcattatacttttttgatgctgtgaatcaataatttttttcttaattttatttgtagaatattcataagaataaaattttcttaattttatttgtagaatgttcattgctggtatacagaaatataactgtttttgcataccgatcttgtatcctacaactttgtaaaactcagttaatctatttgcttttttgtagacttctgattctctacataaatagtcatgtcatctgcaagtaatgagttttacttcatttcccatccagatacctttcgttttcttaccttattgcaatggctataatctcaatgacaatgttaaataaaaatagtaagaatgaatatccttttcctattctcaacctcagaagcaaagcactctgtttttcaccattatagatgatgttagctttgagttttttgaagataccctttatcaatcaagctaaagaaatttcttttctttctagtttgttgagagtttttatcatgaatgaggattggattttgtcaaaaacatttctaaatcatgtgggtttttgttttattgtattaacatattacattaatcactttcagatattaaatcaaccttgcattctaacatgtgtttttttctttttcctttttttggaggcagagtctcactttgtcacccatcctggagtacagtggtgcaatttcagctcactgcaatctccgcctcctgggttcaagcaattctcccgcctcagcctcctgagtagctgggattacaggcgtgctccaccatgcttggctaatttttgtatttttagtagagatgaggtttcaccattttggcctggctggtcttgaattcctgacctcaagtgatccacccacctcagcctcccaaagtgctaggattacaggcataagccaccacatccagctcctaacatgtgtttttaatggctatacctagtctttcctcatttttatcctactataactaatttttatgagcaaatacagagctacatcaactggggatcctccaaaattgacagtaagaaacatgctgttgcatttgcaggcatgcccagggtccagataagtatgcataaatattgtgttgccatagtgattaagggcattcttcccaagatgatttgacaacagcaaatcttttataagtaccttctctagaagtatttggcaatgatcctaccacttctctgaatattcagtagaagtacagatgaagtaggatggtctagtaattaaaagtatgatctctgcagacaggcaggctccccagttcaaattctggctctagcatctacttgctgtgtgactgtgggtaagttaaactctttgagccttagatttctcatctgtaaaatccctctttggtaaaatgggataataaaagctaccccaaagggttaatgggaagattgccagtaaatgttaagtagaacatacagttcagtacctggcatgcagagctcaacaaacagtagaaattacgactaagacagcttcaacaatcccctcagcttgactaaacttcagacaggtttctttgtgagcataggccccttttcttagatcatttactttagaaaacttgcaattataatttctttctctatccctttgtgaagtaaatcttctacaacccaggagcatctttctccaaagcctaagaaccatgccttagaaatgtaatcaccaagaaaaattgcacctttatttctttgtatctgtgggaaaggagaagcctaacttcagtaggtgccaattagcaaacacagatagcctgatcccatttaccgatctcacctctagtgtctttcagtacttactaactcacctcaatgcttaaaattctcctgtctgtttcagtgtgattgagttcaatttctcctccattgtgatagtcttgatctcttttgcaattgtcttgaataaagtcttccttgcctaacttgtccagtgtaacttttcttacattataatggttattatacggagaaagaagcatgggttctcctggttgtttcagctgtataactttagtcaatatccactggagagaatttcaataaaagaaaactatttctttatgggttaaaagggatgggcatggggggcaaaataagaagcactgtggttcaattacagcgttctcatttcttctgaaatcctctagttgagtattgtaatttaaatggaacaacttatctccctaaaagactgattttgaaagactatttccctttccctgttaactgctcccaacccaacagccatcatcatttttaaaggaattctaagggcaaagaaactaagaatctaagagaatgtaatacaattgatgacccaaagaaaagcagcacatattaaattgtgacttaaatgctattcaaaacataaaatcgtgccattgtagtatgtgtttgcctgtgtgtctgtgcctttatttctcaatgatgaattatatttcaatgaaaaagaataatgccttccaagtaatagtatcgttatataagagacaattatgccactaaatttagataatttagaaatagtcttaaggagagaaacaaaaattaaaaagtattgaaatacaaagtaaggaactgagattattgtttttctcaatgaagataatatttacttttgctttaagatctagatatgacaaatgttttctggttaacaatttatccaaaaagaaaaaagaatgtcaaccttttttttttctctattccagagagctccagaaggtttttagatttaaaaaagaaaacaaaaaacaataataatactcaaatgtcatattggaagccttaggcaagagctgttggtcttttaatttgctcttaatactatgatcaaataaaaagaaggaaaattttacaaatcattaacagcttcgaggatgagggaagaacagattttcaagcattcttctttatttagtcagaaatgactggctcaacctcagcctacttctctgaggcacattcctaccaactcttgcatattaaattttgccagagcaatgggcctgacatggccttttgaatcacagtgaatcacagtgacccttatccaactgaatgtctcctccaatcatgtttaatgtacatcaagcattctacagtgccaagatgaagacctgcattgtttttttaaaacccacattaccttgtcattgtgtaagagaaagatatatttaggattgaagggtgcttcttattagacccattcaggaagaaagtaagtctagaggagccaagctcaaaacatactcttcaccatacacaatcaaattcctctcagaaataatgttcttcttctccatctatattttggaaaattacatgaaaatcagtagatacttgtaatgcaatcagtgctgaattattactcaacaagctgagtcttcgagggcaccagcaaaacagcaggaatgactaagaaaagtttaactttgatgaatttatgtagcgtcttgaaataaaatgtaaaaatgaagccattttcatttcagtattcagagttttataacattttgaaaaagtaaattttcttttgaagattttataaattacacatggggttgttattacaatctcttcagtgttcaaggtttctaaaattctcaattcagccctggatacaaaaactctaaacacagagggttaaggtattaaagatgaaagctagtacccttacaactatttatattgcaaaagctttgccctcctgcaagaacatgcagtttcccaaacagtaacctctctttacaaggttatgcttattagctgggattcgaagctcaatagcaacactgttcatccatggttcaattcagattgtaatttctttttaaactacctgacccttataatcatatggtgagttggtctgatcattcatcttctcgaggccaagtacttggtctgaacacagagtcacttgtgtttctgaagcctctctgcatcaagatgattggggtgaaaaactgtcaattgaaaaaagtttgaaagaaaccttttatacaatgttttcattgtcttgttctttttctggaaccacaatttctgattgggaaaacaaaagtcttcctagatacaagaatgaggttttaagagataatctttgtttctaattaagtgtggaagctatcaactatcgcattgtccccaatgtcagaatgtgctgaataagattttgctttttctcagggcccagcatttattaagcactcagcaaatgcttactaaatgaatgaatgactctacccaagcttgtgtctttgtctcgaagctgtatcttccatcacagtattaaaatgttttttatgaacatgagcatctggctgcacatacagagcagcacattccacacactgccctaattggatcaccaattggaggaaagtaagtcacaagctgattgcctagagtgggtttttccccatctctgaaccaatctctgaggcaaaaagaatgctattaggctgactgatttatgtaaagcagtgcctatcatttctgcagttaggatggagtcaattccatccaaagccaatagaagagagacagtactctaaaagaaggcctaggagccatgaataactgccgagggtaccatagacactgggttggacaagcaagaaatagtgacgatgtgacttctatttttatgatggctcagcggaaaattagtaaatacaaccagtgtgttagaaataattccgtatctcctaagatacattggttaaaaagatactaataagtttttgtgcgtgtaacatttgacaccaggcttttaagtaaaacaccctaagatggaacttactgtgtagtggaaagagttagactcactagacattgattagctgactgacatagagcgtttcttatcagtcaacaaaactatttccagagaggcttgaaataaaacagttgactttatgtagattatggttaatatcttttgcagattttctaagaaatctttccctatcagaggtccccaaaacattcctttatcattttccttctaaatcttttatacatgcttaagaaatatgcacatgctctaaattgggggaacatgatcctttatgtattaattgaatcaactttggttaccatgttgttctatttacttttttgctgctcgagctaaaaattgagtgacttcaaatacaacataatagtttttttttccgttttgccctctacatttttactttaataactttgtttagaactgttatacctacttcagttgaaatttttattatttttgagagtctccttatccttattaatgcttttcactttaatatttgtaaggctaatactgatacagctatcctaaccaggtatatttgcttgttttattttccctaattctactttttgtctttctctgtccttgtactgtcttttgtaaactgtatatattgaacaaggtagacttttttttttattaatctggtgagataggcaatttatatttattgtaaccatttattatatactatgccatttctttgctttttctatgctttttcttccttcttgcatttttgtggtctatcaaagttgggatttctaaagtgtttttcccttatttcagaatgtttcctctctactggtttgaaagttatattgtattgctattctttaaaggttatctgaaaattttctgttaagtacttagattaacaacatctaaagtcattcattatcttaacttccatcctaaagagtatcaggatcttggagcactcacactaacttctaagtgctcccggacactttccccacatatacatttcctgagttatgtaaaatgttgctagtattttaattacgctcttttttactccacagagtaaatacttcttaatatagacagtatttatttacatttcccatgattactgattttttagctcaccataccttcttgcatctcagactttcctcctagtcattttgctgtactctaaaattcatctttattcttaagtgaaagtcccttgtttgtaaattctcattttgagaaaaaagtgtttttaatatacccttgattttgaaagataatttcactgggcactcattctattgagttattctctcagtaccttaatgatgttattccactgtcttttgccttccagttttggcactgaaaagtctactgttggccaggtgcagtggctcatgcctctaatcccagcattttgggaggccaaggcaggtagatcacctgaagtcaggagttcgagaacagcctggccaacatggcaaaatcacgtctttactaaaaatacaaaaaaattagccaggttgtggtggcgcacacctgtactcccagctactcgggaggctgaggcaggagaatcaattgaacccgggaaatggaggttgcagtgagcagaaatcacaccactgcact

SEQ ID NO: 739 - DNA, 152544 bp, Homo sapiens
agtccgccattgcaaacacgaagctcttccagaaacgccctcacagacaccccggaagtcacgtacccactctgtaggtgccccggggcacaggcaagcggacgagccagttatccctcagagctcctgctgcctcgcccgctttctctcggaaacgtgaagtgtggcctcagctgaaagtgaggtgggcctcattcaatcagttgaattcttcaagagagaaaaactgaagtcccttagaaggaaagagttctgccttcagactgtctttgaacttaagactgtagcgtcgactcctgccggaatttccagcctgctggccagctctgcagattcacacttgccagcctccacaatcgcagctgaggcggaggaaccctaagggctcattgagatcatggatttgcccttctatgcattgatggagcacctgctgcccacagcgtctgtatttggtgctgggatgctgagcctccttctttatgaatttttaaaaggacactgagatcttcaaacagaggctgccactctaagcaaacagatcccgagccctggactctgaagcttgggcccagttctccttttctccgggtttcagatcccactgtgaagtgagggggcccttctgattcaggacccggggaagccaggggcatgagcatcggtgcctcttctctatttcaaggacccttctgggtgtaaagttctctgagatgccttacatggattcccaccactgcaagataaccatcgtatgtaaagtgttatgaccagcagagcgtaattgaagtgcattccagagggaaagacagcggctcagatgaggcttcaggcttgaccaaatctgactggctggctgccggagacactgctacccatcggcccttaataaatggcctcatttgatcatcatgtgatcttcagaagctgggcttgattatccttgccaaacaaaatgctgaaaccaaaaatctgaaaggtatttcttgctaagtaagggagagctgtgcttgtagagtgtggtcaccctgaacagcgcaaactgcttgtggagctccaagactggcagacttgggagggggagcatttagggattggatgactttggccgtggactcggggttgggacagtgaggctgccactgaatggctgtcactcagaaatgtagttactgataaaaagttgactcaatttgtcagggcaggcttaaaatcagttttggtagttactttttgtcatggctgaagagcaatcctctgtcttcttgaatttggacctttatttggacttgagtttggaaaaactaagaaatttttgttctcattttcattacatgcttgagaaaactgaggctcagacaggcgagtaagtttcccagggtcacgcatttaccggctggcatattaaagttttgaacaaagtccacgcttttcttacacactattctcattagtattagttttagtagtaatcgtagctgtacttttggttcataggttcatagagagttgttaatcctactcctcactgataatccattctcgccatcatgccctacaagacctctggttgtttaattccatttctccttcatgctggatcccatctcccatcccctctccacccctccgacagagtcactctttctaatgtctttttatctgtacctaaatatttgtgtagctttgaaaaatctaatttgtcaagggttatgtgttcattttacatttccatacatgttattgtgcaatatatagatctcatttgtttcctaatttttttcactcaccactgttgtgaaaacacactgacatttctgtatgaccctcttctgacctttgcttcacagcgtgcatctaccataccttaacctaccctgttcctcttgtcatggacccctggattgcctctggctccccccaacacacaccttactgcaacatccacacactggggtctttatggatttccctgggttttcacttaggagtgggattgctggatcctaggagacacccgttaattctgcttggcacagacagtttgctctgtgtggcaggccatattcccatcagcagtgcgtgaggggttcattctgccacatcctcaccagcatttttatactccttgaaagttttgtcagttagatgaatgggtgcaaaatgtaatcttaacattgatttaacctgcatttctgtgtttgccaaggaagttgtgcgtctcttcattacttagcagccattcaagtttccctttctgtgaagctcttattcatataccttagccaatttgatagtccattgtttttattttgttggatttcactatttccttgcatgttctagatgccaatatcttgttgattttaaaagatgtagtcattctccccccaatctgtcacttgtttactttaatgatgcctttttatctcaaacccaaatttttaatgttgctattgaaagggcaaaagttcccttatccctgtcacagggtgtgtgatgcgggagtggctcacttcctcagcgccccgctgctgagacctttaggggagcatgcagatgggccggttgtgtggctccgaccccacggcagcgtctaggggtgaatgtttacagctgctgaagccacagtgggcgtgtgttacaggatgctcttttagttcagccatccgtaggtggcttgtgttagctcaattagacacccttccttatcacaaggacacagggatttctgtatcccggggtttcttgccttggtgtactggaagaatcggatcagttgtgggcttggagaataagtgtaagtttgtttttttgttattttattattattattattattttgagatggagtctcgctctgttgcccaggctggagtccaatggcacaatctcggctcactgcaacctctgtcgcccgggttcaagcatttctcctgcctcagcttcctgagtagctgggactacaggtgcccgccactgtgcccagctaatttttgtatttttagtagagacagggtttcaccttgctggccaggctggtcttgaactcctgacctcattatccacctgtctcagcctcccaaagtgctgggattacaggcgtgagccaccgtgcctggcctaagtgcaaggttttattgagtggaagttctcagcagatggatggggagccagaagggagatggagtgggaaggtggttttcccttggagtcgggcagctcagtggcccaggctgtcctctgacctccctggttgaactctgtgtcgttctgcaggtcaatggcctgccagcctgcctgtgtctgtcagtgtgctgttctgctggggccctctccacatccagctgctgtgtcgtcttccactgatgcgttcctcttgacatccagccgcatgtgcatgtgtgtccgatggggcctcggggtttttataggcataggatgggggtgtggtgggccagggtggtcttgggaaatgcaacatttgggcgggaaaacagaaatgcctgtcctcacctaggcccatgggcacaggccctgggatgaagccctagccagggaccacaccttcctctacccagcacgtccctgtcccccttccatatcactgtggtaaaatccagtttttttcaccttagattttgtacatttgaggtatgacataaagtgcatattcagttcaagataaaaagttttctccaatagtctcctattagctttatttttatgccttttcatttgagtttttaatcaatctagagatcattttacttaggatgtaaggaagagttccaattttagttttacccatcaggcaagccagtggtacccaaagccatgtattaaaaaagtctattcctgtctcactgatgtgtgtcacttctgtcataaaacagatccttaaacacacatgggtttggtgttgagctttctgttttgttccacttatgaatttaatatttctgtaccaaaactgcacttttttttaagtagtattttgtggaattttttcatatcttgtaggtcaggtcccttttattctctttttctgaaattgtttattttttaaagaattttattttttcatgtaaatgtcagaataagattgttgaagtcttcaaaaatcgctcctaaaattttttttttttaatcagaatctcatttaagtatggcttttgtggagaactgccatttcttcaaatgttaaactagtccattatgggatatggtatattttctctttattctaatctttctttatatcctttaatgaattttaaaactttctctataaagaatcatgaattctttgttagatttattcttagatatatttaagtttttcttgttattgtaaatgttatattgttttattattatatgttttagttagaaattaccagtgtgaggaaacatcatggtatggttgaaatcacacctcttaatttttgtagaactcttaattccaatattgcgtgcattgattctgatgcattttctatttaggtgatcatgccatctgcaaataaggatagccttgacttgtcttaatatattcttctacctcttgttgatctttctcttgatgagtccattggacagctttaccagtagcaataagattgcgtttttcttgtttccagtcttaaaggagccatgcctcaagtccatcctctgaatatggtattcgtcaaagacaagcatagttatttatcagataaagaacattctcctttagttacagtattctgggaatactgtatgtaataataataatgtaaataattttatttaaaaacaagttggatatttacaagtgcatttttttttgcttctactgacctagtcaatattttttctttcttcatcttagtatcttaaagtggtgaattaaattcataggctttctgatgttaaaactttttttcattcctttgatgaactctatttataatgatattattattattttcagacaacattaaagtcaattagcaaatatgtaagtaagacttcataagtgaaaagagcctatactttgcattttgaagtttttttttttttttttttttttaaaccagctttggaatcaagcaaacaattttataattaacagaaggtctctgtctctgtctgtctctctctctttctctctcattgtttggaacaacttgtgatttgtgtaagacatagattctttcttgtttaaaagtttgatgtaacttttttgtggaatgttcttggcctgattttttattgcctttttttttccctcttgggggaggctttaattaccattatgaattttaaatgaaaatctatttatccttgctccaatttggaatatcatacttttccaacagtgtgtccatgttgccttgtgttttcaaattgatgtctttataaaaaagattttacattgtttttgcagttatttcctcttttggattctgttttgtaaatttgcatcttccccttattgtattgactagatttgccagagctttttgtatattgtattaatattttaaagaaattgcttttggttttgttaatcttccctatttcattgatttatgttcttatctattttattttcttcttgtttgtcccttttgggttgcttctgtttcttgtttgttttctgcttggattgaatacttagctcattttttcttactttctgataaatacatttaaacatatggagctatcactacagtgtggctccattattttgtaattctcttatgttttactttgtatcttaaagtccttttagcagaatgacattttagtttttgaacatatggtatattatttatttttaatcatttttgttactggtttctaatttcactgctttgtgctcagggaacatactaagctgggtggattgtttgggctcattgtagcttccaacctcgtccatcatccgtggttgtgaaagcttcgctccacacacacatatattttgctctgggatttttattaatcttgtcaatcaaattttgtatgcatttatgcttttttgttttgatttttttttttgtccctctaatctaccagtctctaatagggctttgtgaaaatcttgggcaataaattttgttgtctctatgttctcttgtaatgctgtcagttgttattttatatattgtgatgagctattttaaagggcttatttattcataactactatcttcttgatctagcacactgttttggcagtatataacatcgctttttggcatcataatgtttttcatcttaaaacccatttagcccaatactaaaaagtcttaccttgtatttgaaaaaaattcttattgaaacaacctttggaaactacacacatactttccttttaattatttcatgtattaatttatgtaagttttcatatccatttttacttctcattatgaatcaataaattggttttctgaatttaactcttggactagagattctgctctttgtgtgccgagaattagtttgcagagacccaggtctgcagccatcatgaggactcaacttcgccacacctcacggaagagccccctgtcttctccccagtgctgtgtgatgcagattccttttacagcctgcctgcctgcctccctccctccctctctctttccctttttccttccttccttctttgaatgttacttttttccttctctgaattgtaatacagacatatggtaaatggcataaacatggcacacgttgataagtaaggaaaaggagactcccctgtaagtgctcatgacctcaacaccaggtcatgaaatggaatattaccagcagcctggggttccctgtgtgcccccagctgtctgcagtcatttctgtctcacttgcctctaggtaacaactattgtcaccttagactcattttcttgcgtttctttatggttttagctttggacattcagttctgcctgtgctgtttcatgcaatgaaatcataggtgagtctcacatgagtggaattgtatctgtcttgtttcactcaacattatgttttgatgttttggggtttcatccatatttttggatgcacctgtactttactcatttttgcacagtctgggagtttgttgtatggctatacaaccatttaattttccactgttcagtcgatggacactggagttggtttctagtttggggcaattacaggccaggttgctaggaagggtttcacacgtgtgtcctagtgggtgtgccagtgagtttgcctagagtttgtacttagtcatgaattgctgggtaggagctattacctgcaacttgactagataatatcaaatatgtccaaagttgacattccaatgagatctccagggtttgtgagctgttattgttccgcgaccacactgatattcatatttccagttgtttactaaagggctaataagttataaatacattcatttgcttttcagtctagtgggcacgtgttgccatgactttattttgccttcccctgattagtttgttagtcatttttatcctctctttctaagtatctgttcctatatttttgtctaccttttggggttgcttgtctttttattgatttgtgtgagttaaaaaaaaaaatgcggccgggcgcggtggctcacgcctataatcccagcactttgggaggcgaaggtgggtggatcacgaggtcaggagatcgagaccatcctggctaacacggtgaaaccccgtctctactaaatatacaaaaaaaaaaaaaaactagccgggcgtggtggtgggcacctgtggtcccagctactcgggaggctgaggcaggagaatggtgtgaacctgggaggcggagcttgcagtgagctgagatcacgccactgcactccagcctgggcgacagagcaagactccatctcaaaaaaaaaaaaagcagccgggcgcagtggctcacacctgtaatcccggcactttgggaggtcaaggtgggcggatcatgaggtcaggagattgaaagactgtcctggctaacacagtgaaaccccatctctactaaaaatacaaaaaattagccgggcgtggtggtgggtgcttgtaatcccagctactcgggaggctgaggcaggagcgtgaacccgggaggcagaacttgcagtgagccgagatagcgccactgcactccagcctgggcgacagagcgagactccgtctcaaaaacaaaacaaaacaaaacaaaacaaaaaaatgcttgtcttggtgcagtggctcatgcctgtaatcccagtactttgggaggccaaggagggaggctcacttgagtccaggagttcaagaccagcctgggcaatgtagtgacaccccgtctctactaaaaataaacaaaattagccgggtgtgatggtgtgcacctgtagtcccagctactcaggaggctgaggtaggaggactgcttgaacctgggaggttgaggctgcagtgagctgtgatcatgccactgcactctagcttggcagacagagcaaggccctgcctcaaaacaacaacaaaaacaaaaacccatatatatatgctttggagatgagctctgttttttgattataagtgcaggaaataccttctcctgctccgtgtcttgtttctcactcttgcctaatgtcttttgatgaccaaaagctcctaatttcagtgcagtcaaattcatccactttttttatgtctgagaaaatcttatcttaccctagtattaaataatatgttagcttgatataacaatctgggcacaattcttttcttaatatttaaaaattattgttatgctattgcttggcttccattgttgacaattgtgataccaactcgattcttatttatatttattgctgtttttttcctgataacttttagattttttccttatttctcatgttttaaaaatttcttttacctttatctagttttgcttttttctttctttttttggaccctttgagtcttttaaattcaaggtcttgcatttcctttatttcttgctaattgttggtcatcaatttttaaggcatcctctaatctctgttcatttctctgcccttctggcaattctgttgcatgcacttggcacttccctcctccagcgtccctccttgcattttctgtctctccatttccccttcatgcttcctggcgctagcccgctagcccggtcttgctctttcacatactgatatgtcctcagttgtatccattctgttactcaactcatccactcggttttaaataccaactagtatgtctttcaaatgtatcatctccagtgtagtcttctttataacttacttcagctccatgtcttcgtcttttcttttctcttttataacatctttcatttctactttgatatagttttgtttaaaacatgatgatagcccctaaatgccatgattttgcattgtgagtgagctaagaatccctgaggacattaagcattgtggccagggatgcttccctggggatgtgatggctgcttggcctggcttttggctttccttctgggttgtgcatggaggagagatgcctcaggaaggagtctccagtgctagtctatgtaactctcccttgcactgctttttttttttttacacagcatttagctcttgttgcccaggtgggagtgcaatggcgccatctcagctcaccgcaacctccacctctcgggttcaagtaattcttctgcctcagcctcctgagtagctgggactacaggcacatgccaccacgcctggctaattttgtatttttactagagacggggtttctccatgttggtcaggctggtctcaaactcccgacctcaggtgatccacctgcctcggcctcccaaagtgctgggatcataggcatgagccactgcgtccagcctgcactgctttttaaaaaagtttttcatcttactcttagtgttaatcatctcatcttccagatctgggggtggtggggcagaggagaaggaccctggggttggcaggtccatcagatctggggttcactcctggggtctccatggggcctgcaatgaatagcactcttcttttccctgcccgtggcccccaggcctagacatgtgagaaagggtaaagatggagaccaaaactttgccttcatgttagaggcttatttagaggccagagctctaaagagacctgcaagctgaacccatgagaagggggtggaccttctcccttgcggcctccaggggccagccctgtcccagggaggaggggcacagctgagcccggcaggcccagctactttccagcgcagagtgagtggaaggtaggagaggctgggagtgtgggaactgggacggggaatgcattcagctcttcagcgtgctcccgtgcacatctggctgaaagcagcccccatgtcaccgggacccagcctctgctgagatgatagcagctgcatttctctctcgtaggcctttgtctggcattggctgactcagcacaacataggaagaaagaggaagaaagggtgctcccctctctgctcgcttaccccgctgaaaaccctcacttttctccactgtgggcagttgtattttccaccctaggaagcagacaccttttgccacctcagggcccctcagggcctgtgtgcggtcacccagcatagcccccacctctctctggctgctatggtgcttacagggcttggctcagggaaggttgtcggcagtcctgggccactttgccatgtgttggaaatcagaaccttccatgttcctttcatagctggagctgattttcccagtggcgtgcacagctcccggcctgggctgtgtcgtcttggggaggtggaatttgctacctctaaggtggagcagtagttagtgttcctggaacaatcgtagaagtaagcaggccagaggtgaatgaaacgtggggacattagcacagggggctggggcacactgcatgggtgggaaggggtgtcccttacatcaggggcatggactgtctagagagacaccatttgtccttcaactccaggtggtgtttcaaatcctgctggtgtccagaggcctggactctgtccccatcctataaggatttctgtgactgctgccgtgggactggcatcacattctcattgaggggacatgctttccttggttctaatcctgagtctaagaatgtgaggtttgcctaggcagtgtcactgtcctaatcagcaacaattgtctcttaggcaatgtcatcatcctgaccagaaacaattgtcccttaggcaatgccattgtcctcaccacaacaattgccccttggagtggtcccctgattggcttttgttcctcctgaggcctggacaccacataatttagcggactgagaacctaattaataatcatgtgctccgatgtccaccaacatcaatcgtttggaaaatctggagtaattaggaaatgctgctgaactagagaaactgttcccataaaatgtcaggtactttatttcctggaggagtgaatatcttactgactaggtcttatgtgtaaaatgcagtattctgagttaccaagttgtactgttgaaattcctttaagttggatggtggcatggaagtttctggaagctgaattctgaatagttttaatctttctttgagccttggtttcctcatctgtaaagggcataatagctttgtaaactgaactaacaggatggaatcaaaggacagcaatttttcttatagcattgcacaaacgttagcttggcctcccaaagaagcttaattttaatttaatttcaggaagaaacaaaaatgtgtgaagatgttaaaaaaattttcgctagtcatcattcagcttcagtgtctctatcatttgttttttttttcttttttttttttaagtatactttaagttttagggtacatgtgcacattgtgcaggttagttacatatgtatacatgtgccatgctggtgcgctgcacccactaactcgtcatctagccttaggtatatctcccaatatcatttgtatcagtatagctcaactgaagcgcagggaacgttctctgagccaggctggggcttctggcgggaaccggcgttccctaggaggagcccctggtgcttatgcggtggagggtggagtcaggtctgaggagccaagggctgtttggcggtgagacaaggagaagcagcagggggtttagtgtccaggccttggggagctgggagtcccctgcagtgggaagaggatgcaggggtgaggcccgtgggacacgtgggagccaagtacaatcacaggcaaaagctgggtctccaccaggccagcaagcatgaggtcacaggtccagtcacccacccaggtttgcaccttgggacaaggcctccgaccagtgtgcggtgggtagggggtctcctttgtgagtaacgggatgggaagagaagcgagggtggagaagccaccagaggtgttgacgtggaggctaggaatgggttctgttggtcttcccagcatgggtgtggccggcgggaactggaggagtgggcacaggggtgggactgaaggcaggtgtgctggtggaacgggccctgccaccaggggccaggaggggacttgtgattgggggtgtgtggaggtgagtgtggtgtgtgggggcagcgaggtaggtgggagaagaaaggtggattcttggcctcagactcactaactatcaggactcccagccaggctggaccacaaggtccgaaagtggccccgactggagtagacgtgcttggaggcttctgggcaggtgcagccacgatgacagccggcatcaaggcccttcctctgcaggccccaggtgcaggccctggtggtttgggttcagggtttatgggtgatgggcgcccagcccagtcaggttcagcggggagaaatccaaagccattctgaggggcaggctccaggccggtgcgaaacagtggggaatggcttcccgagaagccactggagctgcgcctcttgccctctgtccggtcctcctccacactccagcagaggggggtcttccagggtcctttcctcctgtggcctgggcgtgcccgtgtgcagaaggaggaaggcgaagccgtccggcatctcggaaatggagcctccagggtctgcgtcactcggaaaggcgcgggctttcccaggccagagtctttcagtcccaaaaggctttgtccacctcctccctgagtcattgcggctttgtgtgggtccaggggcagagaccagcaggaaggacgctgctcctgcctgcgtgagaagcccgtggtgcacaaacgcctctcactcctctcagtgatggaaatcaccatcagataaacaccctggcctcccattttgccttatctgccccacccccacccccccctacaggcacacacatccaagctgtttatcactgcacttttacttacagtagcccaaggcttcccatgtctagaagacagaatctctagcctggcactttgtactctgccctctgatgacctcttcaatccgaatctcctgccagcctcccgctctgtgctccagaaccccgagctgcacacaagtgtctctggacgccatgcccttgcctacttctgtgtctttgtccatgctattctctcagctggcacttcctctccggctgtgcacaccgggcaaactcctattcataccacaaaacccagctctaatactccctgctcaagggtcttcttggacccagagaggcagaattcataactccctgccctggatccctggagaaagctttgctttcccctgttgccctgtggattgtaatcaatccccactctgagtgggtggacagaagcctttcctgagaagcaggctggccgtcctggggtcctgggcttgatgtacctcccgtgcagtgcctggctagagaggaggcacagcctgcagagcatctgttctggactgaaccccggagccatcagcaagtttcgggcaagtgttgggggcttggaagaaggacgattcattctgagattgaacctgacatttatttttctcccacatacacccagccttgactttgcagagagttaaagcaaatagtaatccaggacagatttgttacatatttatttatttcccttgaaatctctacgactgcaaagaaggtgtttattttaaaatttaaattgtagctagcagagtgttgcagtgactcacttaatcacctcctccacctgaccaactccaccaaaatccctgctgcagcttcccattcaaacacccccttcacaattgtgatttttctccgccaggtgactgacagatggcctggctgttttggatgccactgccactgccaaatcactgattttgaggaattaaatcacaaaaacttacctcaaatgcaaaaaatgaaaaggaactccttcctcatttcctgcctggtgtggacacagtgtgctgtctacacgaggccttgttacaaatctgcaccccgctgcagttccattgtgcctgcagtagagaaattccagagcctggggacctgggctcaggcccttgctctcatgaccaggcagtggcagcggctcttcccactaagctgcccggaaggagctccagggactcttggaaaatgtcactgacttctcctaagactagtatcacttctccaagtacccctagtttccctccttccagcccatccttcatataattacccaatataattgtgcacacctggcaaactcctatttatactacaaaacccaacttcaacactctctcctcaggagtcttcttggactcaaaccatctgaaaggcaagcctggtggagtccacttgctggacagccggaagcagctccttttgcttttggtgggaagctcagacttcctgacaaggtccatgtgacccctcctggcctgattcctgcccctgctctccctgcccagcctcctccctcccaccctgtccccgtgtccctccagatggaactatttggtgcatctctaatcatctgtggtgatggaatggtatttttccatccatcacagatggtattttgaaaattacagcaaaaagaagttactcaaaaactgaaagcaaacagcatacaaaatatagactccacttttttttttggagacagagtctcgctctatcccccagctggagtgcagtggaacgatctcagctcactgcaacctctgcttgttgggttcaagtgattctcctgcctcagcctcccaagtagctgggattacaggcacgcacctccatgcctgactaatttttgtatttttagtagagagagggtttcgccatgttggtcaggctggtctcaaactcccgacctcaggtgatcctcccaccttggcctcccaaagtgctgggattataggcatgagccaccatgctcggcccagactccactttttatcattaatttcaacagacataaaattactctgtcaattttctataaacatttctaaacactcaatttttgtttccatctcatcgaggactgcaacaaaggctggattggcataggtccacagaccacactgggagaagctctgatcgagagttcctggaggagccggtgtgctctcttgccctaggattgctcatgctgtagcctctgccagggacccctccacccgtcgtgggcaaccgaactctcactccccttccagactcggtttcggagcctcccctcctccaaacatcttcctggaccttgtccaagtcgggtgccttcttccctgtctgtttcactgttgctggcctctacccagcacctcatcctgcctgtgggatagcgtaggtgctcggcagtgtatgtcttgagtgactagacctgtagtaaatgcaggaatgtgaagatgctgctttataccagtgcttctccaagtgcgggccacagatctccatgtgagtccgaccactttgggttccacactcactcgcgagggaattctttcatggcgtgatctagggaagaacacacttggctccagagaatctagagatgatttacaaagacatgtggtgcggtttgcttgcaggccaggaactgatgtcttgctttctgtgtccatttgttgattctaacgagaaacgttaatgagatatccctcagcagatggtaggtatggtggcatcaacacagttttacactgaaatccttaggctcaaaaggataaggcagaggcagaggagataggaaaaggatgcagatggaacttccagagatgaggccgggcgcgggggctcacgccagtaatctcagtcttttgggaggctgaggccggcggatcatgaggtcaggagaccgagaccatcctggctgacacagtgaaaccccatctctactaaaaaatacaaaaaattagctgagcgtggtggtggacacctgtggtcccagctacttgggaggctgaggcaggagaatcgcttgaacctgtgagcggaggttgcagtgagcagagatggcgccactgcactgcagcctgggcaacaagcaagactccgccaaaaaataaaaataaaaataaaaaaggctaacaaaattggtaagacctcagcaagactgataataaagaacacacacacgcacacacgcacgcacacacacacacacacacacatagagtgaggtaagggaacggaaagctgctaatacacaatatcagaatgaaagagaggatattactaagggatgcacagatgttaaatggatattgctaaaatcttgatgttggtaatttttacaacttagatttaatggataaatttcttttaaaaaataacttaccaaaacaagaagaaatacaaaatctgaagagccctaaagctatgaatacattgaattgataattaaataccttttttacaaaaaagctctaggcccaggtagcttaaatgatgaatttaacatcaaactaagaagtattaccaatcctatacactctatttcaaaaatgaaggaaaaggaaatattcacttttaaatcatttcataccagtgtaactcggatactaaaacctaacaaaaatattacaagaaataaaattatagcccaataattctcatcaacagaaacacaaaactcctaagcaggacattagcacatagaatacagtgataaatacaagcacactatgcgttactaaatggggtttattctggaaatgcaatgtttgtttaacattctaaaatcagttagtataattcatcactgtagggccccccggttccccgctctttctttctgtgtcctgaccaaaagtcatggagtgcattgaccactctgtgacccagccaggtgcaggttttccccagcagacttgaacccaaaccaggcccttgaacattcctgggcactgataaaggtatttaggttattgcccaaaacgatgaaagaaactggccgtggccctgagtcaaattccttaagccctcatgaaaaccccatgccttgtccccctcgctgaggacatacttaggtagaacacctcttttctctcactgcctgtctctaggagtgctgcagccctccgcagttaagttccccattgctgcagccctctacaggtaagttcccctaatcaatgctttgggctgatcacccaggcattctgcgcttctttctttggaaccccaactggtctcatccccaactggggctcagtttggagatgcctttgtgggaactcccctaagttgggatgtcttcagctgtgggttcagcaggatgagacaacatattaataataaaagacatacatgaaaaacctgcagctaacatctgacaaccaagataagcgactgaggcataagtctcagtcatcaaggatttttaaggcagctttagggcatgtctgggaaaaatactagccacagacacacctgtggctgttttttctgaagaagttttcaggaggattagtaggaatacttttccttgtagtgggggaaggcctccaggaagaggggcatgtaggtcttaaggggaatggctttttttcctatgagactttagtaaatgcccagtaaatctacatttcacgtaagataagatgaatgtttgaagagaaaaaaggaggaaagagagtcagttatacatatgtctctgggtaggtggaggaaatgagtcttgtctttgctctgcatctgggaagataagcttgtaatcagcattatcagtgtggaatcaaacagatttagtctgaggagctagacttaggttgtagacctaaactcacaattagcatgtccttgtttatgggaggcaggcaaagaacttactggtgaatgatatgtaggggcagcttttccagatgcctgcagccttttaccttttcctgggggtgtggcagatgcgtgttgctagtgacagctcttcatctggaagagggggttgcatgaggcagcctcggtgctaaagtttggggtcttgagatttttcatctttctttacacatcatctaacggtgaaatattgagtgcttttaccataagatcaggagcaaggcaaagagtctgcttttgatcccttctgtataacattatagtgaaagctctagctagggttagcatgcaagaaaaacatacgtggtaaaaataaatatttgaaagtaaaaagtaaaactgtccatgtcaacagatatgtatgcattattgcttacatagaaatttcttaagcaatataaaacagcaataaaaaaggagcagattaataagtaaatttaaaattgtcacataaaacaaatcaatataaagtttgtttcctattagcagcaaacaattggaaatcacatttaaaaataatttaatttatgaaaataaaataaggataactttaaaaattacacatgacgtttttatttgaaaaatgtaagtctattaacataccatataagtttataaagtaactttataaagttgaaaaagagttacataaatggagagatataccatgttcatagatttggggaatcaatattatcaatgtcaattctctccaaactgatacatatattaaatacaattttattcaaagttaaaactcattttttgttagtaataatttgatactaaaattcatattagtatgcaaattacataaatcaatggaaaataatacagagtccagatcaactcgtacaatataaaattaattaatttttgacaaagatgtcaaggtaattcaatggagaaaaaaagtatgtttaaacaaatagtaatctgacaattaaatatcaatttaggaaaaaaatcaacccttattttacaccattcactgaaattgagactatagtcttacatgtaaaatctataactgcaaaggttttagaagaaaaccaaggaatctaattgcaattttggaatagggaaatgtttcttagcaggatacaaaaagcaataaccataaaagaaaataaatggacaatttgagcttcctcaaaagtaaaagcttcttttcatcaaaagatactattaagaaaatggaaaggcaagccacagactcaggtaaaatattgccaatacaatatggcaatacagtacaaacatttgtcccaagacaaatgacttgttttagagattacatgggaatagcccataagtcagttacaggtccagcaaccatagaataaatgataaatgatttaaatagctacttcatgaaagatttgtgggcaataagcacaagaaaggggttaagaacttcagtaattaaagaaatacaagttaaaaccacaatcaatactacctctcatccagagagatgattatattaaagattaatggcatcaaatattggtaagaatgtagattaatgagaatctccatatgttgctggtggaagagaaaaaagtatatgattttggataggtattgatcagtttcctataaattttaatgtatacctatcctatgatctggtaattcctgctccaagaggaataaaaacatactttctcagaaaatttgtaaatgaatgccatactagctttatttatagtggctccaaattgtaaacaaatttaaatgttcatcaactggagatgaacttatagtttgtagaatattaatacaatagtatactactcaggaataaaaataataatttttttttattggaataaggtggataaatcttaaaaacattatgatatgtgaaagaagccaacccacagagcacatactctgtgattacatttatacagagttcaagaatgggcaaagcaaatcagtgttgctggagatgtaaatgatgattgcctatggaggtagggagtgtaaaccaaaaatgaaattccaagccccccaacagactaaatggaccccctcttggccaaggagattacaaagaaacctgaaatccagttcaggctaagatggcaaggagcaggggtaggacatacctcattataccctctcccttttttttttttgagacagagtcttgctctgtcacccatgcatgacaatggcatgatctcggctcactacaaccttcatctcttgggttcaagtgattcttctgcctcagcctcctgagtagctgggattacaggtgcccgccaccatgcctggctaatgtttgtatttttattagagacagggttttgccatgttggccaggctagtcttgaactcctgacctcaggtgatctgcccacattggccttccaaagtgctgagattacaggcatgagccatcacacccccctctcccttttgaccttgagacagaactgaccagcattgacattaaaatcaagattctaagactgacaatacagactctttgtagtagtaagataccaactccaacctgactctggtaagtaccacatgacagataacaggtcctaaaggaaataaaagtattttatcccaaaatatatttctgtgacatattttgaaatggccctgcaaagctgtctcttgtggggaaaatctacattctttagagaatctgcttccctttccatgttttctcctaatccaggagagatttaaatcagagtctgatacttttaagttctgataagagatatctactatctattctctctgaagcctgccacccagagccttcatctacataacaagaactttggcttccacaacccctcttatcttaaccctcaaatttctttctgctgactccaacactttagggaagcttaactttttcaaccaattgccagttaggacatttttgaattcacctatgacctggaagccccttaatttgagatgtgctgtctttctgggtcagacgaatgtaaaccttacatgtagtgattatgtttttgcctgtaacttgtctccctaaaatgtataaaattaagatataacccagacaccttggtacacgttatcaggacctgctgaggctgtgtcataagtcgtagtccttacatttgcctcagaatattttatagagttttacagaattaggcttttttttttttttttccaacagaaagtgactggaggggtgctttctgaatgatgtaactttctgaatgataaaaaggttctaattcttgataggtgtgtatatgtaaaagtttatcgaatggtacagtcaagatctgtgcatttcattgcatgtaaattttccctcagaaatttgaaaaaagaaatgtggatagtctgatataatttatccatgccaagcctacttttttttttcaatttttattataaattttcctttgaaaccatggccaaccacaaaccaccaacctgtccccactctcaatagaaatctcaatatttcaaacagcaaaatagagtgagaggacttggccctcttctatcctcccatcacctccctctggtgattatttgtggtgggaggagaactgctctgttctcccaaaccaccaatgcactcactctgcttccacctatgctgccttccctcattgctccaggaacccgtggaagaagtccaaaaataaatatcctgtttttctcaatgttttaggtagaatcagtggtttctcacttgaaagtgatccaatgtctttgaaagaagctttctttaaaatgcaaatgccattattttctccacagtgaaggaaagaccctggctttcctccccagctccaagtgggctgttctgattgcttccgggtcctgtcctcatggggagcagcaccacgggagactctgcctctgctgagttttctaacattagtgtcgggaaacaagaatctgccactgatgctccttttgtaaaggtataaacatgtatataaaggaacaccccagcacacccttcttgtccttgtcctctttttcttcctctgcttcttcatcctcattttgtctcttctctatgcttgctgcttttctcctttaatttttcttttgtcttcctctgtttccccccgccccacccccactcactgctgctgttttacacttacttggctatctgtggaatttgtttccagaaatattggaaatcaacatgcctatgggatagaacagggctggattacagagtagagtcgacaactttacctcttctagccagaatgaataaacatctgtttaaacagaagtctaggaaccatgaagaactggaggaggttacccaagagctaagaaacaattgggtggagtttggaaaggcagggatttgatagagtgcacaaaagctccagaggaatggaaatcaaatgcaagaagattttggttcaagataagaaaaaatgtaccaaaaggaagacttatacattcataaaatacctgtcagttccctattagcagaagtttttacatttagaattgattggaaattttagaataacaaacatttttaacagcacataagttacacagggaaaatctgaattcaaatgcctcaaagcaggtgcaattttatttatttatttatttatttatttatttatttatttatttatttattttttactgtcatctgctggaaatgtaagtccacaaccaccaagaatactaagatattttccaaagtgacattataaatcagtaaatggttatggaaaaatatcctttggccacgttgctctgagtttagaaacaataataacggtcataatgataacaacaaactttctaagttcactgtgtggtataaaaatacaatggcggccaggtgtggtggctctatgtctgtaatcccagcactttgggaggctgaggtgggtggatcacaaggtcaggagtttgagaccagtctgccaatatggtgaaaccccgtccctactaaaaatacaaaaattagccaggtgtggtggcgcgtgcctgtagtcccagctactggggaggctggggcaggagaattgcttgaacctgagaggcagaggttgcagtaagctgagatcatgccactgcactccagcctgggtgacacagcgagattccgtctcaaaaaaaaaaaaaaatacaatggttttgtttttttaaaacaagatatcacagtatacaacctataaaatgtggcaatttaaaatgtttaatggaaaatggtgtatgtaggcaacttatatgttgctattcaacatttttctgaatgtcctgcccaatgcaatcagacaagaaaaaaaatatataataaggaagaaacaaattgtcttttctttttttgaaggtgatatgtttgtctaattcaaagggaaagaaaataaaaataacaacacatctgacattcatgtccataagaaaagagatcagtaagagggctggataaatggtgaatatttttttaaaacatttccttatacacgagtcacaagtttcttccttaaattctagactcctgtgcaggtacaatgcctgtttaatagcactacttatttcgtaaattattctctctttcttccattccacagatgtttatgtaacccctattatgtgccaggtcttctttgactcactagggattgagtatgacacagataaaaagaaaatcctgcctgcatggaccttcccctccagtggagaaccaaccggactattaaaaatgatatatttttggttaaaatcatgtgtggtatattaggtagtgatgcctgctaaggaaaaaataaagtaaggaaggcagggtgcagtggctcatgcttgtaatcccagcactttgggaggccaaggcaggcagataacaaggtcaggagttcaagaccagcttggccaatatggtgaaaccccatctctactaaaaatacaaaaattagccaggcatggtggcccgtgcctgtagtcccagctacttgggaggctgaggcaggagaatcactttatcccagggaggcggagcttgcagtgagccgagatcacaccactgcactccagcctgggtggacagagcaatactctgtctcaaaaaaaaaaaattaaataaaataaagtaaggaaaacagagagaattgatagaaagagggttatgcttttagatgggatgcctgagaaggtctaggggagagggcatagaggtgtgaaatgcagaagagcattctggatagaagatacaaagaccccgaggcagcagacttcatggcatgctccagtggccttgagggccagtgatatggtttggctgtgtccccacccaaatctcatcttgaattgtagctcccacaattcccatgtgttgtgggagggacctggtgggaggtaattgaatcacaggggtgggtctttcccatgctgctctcataatggtgaataaatctcaggagatttgatggttttgtaaagggaagtttccctgcacaagttctcttctcttgcctgatgccatgtgagatgtgccttttaccttccaccatgattgtgaggtctccccagccacgtggaactgtgagtctattaaacctctttcataaattgcccagtctgaggtatgtctttatcagcagctggacaaatacagccagtgtacctggagtagagcaagagaagagaagaggggtaggagaggaggtcattcaggaatctgggtcactgtgaggatgttgcctttgtcatgagagagatgggatgccactggaagactctgagtcgaggagtgacctgatttctacttgacattcaagacagacttcttgactgcccttcacccacactccaaaacttgctcctttcccggtatttccaggtaacaagtgggttctcttctctcttcgctggtcactccggccatgatccttggagcctttctcacacctctcctcttctgtgacaacacaccaaatccatcatcagatcctgttggccttacctttaatacatagctcatcttctcaagattccatgctggtctaagatataatccactctctcctgggctagggcaagagcctcctgcctcatctccctgttttcattctcaccccctatgctctgtatttcatagtgaagtcacaatgattcttaagaatataaaaatcaaggcatgtcttttgcatgctcagaattctccaaacccttcccatcacatctagaaaaaaacatcagagtccttgctaggtgtgtacagggatccagggtcttgcccattgcctttctgatctcagctctttctattcctgcccagttgggatccagggtcttgcccattgcctttctgatctcagctctttctattcctgcccagttgggatccagggtcttgcccattgcctttctgatctcagctctttctattcctgcccagttgggatctagggtcttgcccattgcctttctgatctcagctctttctattcctgcccagttgggatccagggtcttgcccattgcctttctgatctcagctctttctattcctgcccagttgggatccagggtcttgcccattgcctttctgatctcagctctttctattcctgcccagttgggatccagggtcttgcccattgcctttctgatctcagctctttctgttcctgcccagttgggatccagggtcttgcccattgcctttctgatctcagctctttctattcctgcccagttgggatctagggtcttgcccattgcctctctgacctcagctctttctattcctgcccagtttgctttcacttctgaatccctgaccaacttgcagtttctcaaagaccccaacacattccctctttaaaaccatttcacgtttttttctttgtcaagaagagttcttcttcctgagtcaccagctcatgtactttctgtctctgctcgaatttcacctccttagagaagatagcccctgtgttcctattaaatggtcttcccttatcatcctatttcaagtgggcacatgctccatcatgtaatctatagaatcaatgaactgaccctaaagaatctggccgggcacggtggctcacgcctgtaatcccggcactttgggaggctgaggcgggaggatcacctgaggtcgggagttcgagaccagcctgacctacctggagaaaccccgtctttactaaaaatacaaaattagccagatgtggtggctcatgcctataatcccagctatttgggaggctgaggcaggagaattgctggaacccgggaggcggaggttgtggtgagctgagatcgcaccattgcactccagcctgggcaacaagagcaaaactccatctcaaaaaaagaaaagaattcggtgaaatttttgtgccacttgacaaactaattttaaagtttgtgtggaagaaaatttgcaaaaagaagaatatataaaataattttttttgttttgaaaaagcaaaacaagggaagagttgtccacaagatatgaaattgtagtatggtgttgaagtaattaaatcagcatgctgttggtgctaaaacaaataataaattgaataaatgagggggaaaacacattgatgtaaacataagatttcagtttatagtaagtgtttaagagaggcatttcaaattcatgatgaaatagactgttaagtaagtgatattggaacaaatatctaaccatataagaaaggctaatatcgtaataggtgacattgaacagtaaatgctaaatattaaatcataaactattagaagaaaatatgaatttatgataatcacttggtatctaaaatcttttccaaaacaaggtggagaatttggaagccatgaggaaataagaaatacagagatatttgacctaattgaaacaaaaataaagtactttgataataaaacacaacataaacaaaatttaaagaaggtttcaaactgtgagaaaatgattattccatgcgatgtaaaaagcacagtaccttttaactaataaggaataggcctccccccttgggaatgcacaaagcctttggccaggtaattttctctcgaagaaatagaaaacaatcatgaataacataaaagatcactattatgaatagccatggacatgagaattaatatacaaatgaaatattttagctcaacaactctgcaattttttattgacaatatcaagcatcagtgaacttgtaggtaaataagtttgttcaatataactgcagatgattccgtgtaatagagagagaagcctctcctactttcactccttgacccccagacccacgttttctggctaaaggcagagaaagccccacacagtagtctctgattccaagcatctaatgcaccctgtaagacttaacccatcctttgggggtattctgtccttctgtgctgtcattgagtcttcagagtgcttgttcacctcatgaataggccatctgcttctgggtgatggggtatgcggtgagatcagctaattccctgggtaggagctctttgctgtcctcctttgctgtggaatgagttccctggccagaggctgcactgacaggagggctgtgttggtggagaatgcattctgcgagcccaggatgttggtgatggtggaggcatcacagggtgggaaggcgcagccgtagccaccacaggtgtttctttctgtgaggatgcatctctgtcttgtccgtgatggaagaagtccagtgtcatcaacctgcctccagatggccagctgctccccgcggggaatggtgccacatgggggctcaatgttggtctctgctgctggcagattgggcacccagaagtgacgtgagccaggccagacttgatgagggaagtccatgccaagtgcaggcacagcctccatccctgccaccatggccacggtgtttaggagcccattggacgatgacagggatgactggggaaggtggcagccttgtatccacagaatatgttatcttgtccacctgagtattaagaatttcttccaggtggttgttttttgggggcattcattcacatgggacacacatattttcacagtctgtttccattctgagaggtctatccacaaacctcttcatagccagcaatcttccagtcttgctctttccaaaccattagcaaatgcacacacatcagtgtgggtctgtgcttctagccagctctcactctaaacctaaatactgctcggagctctgctcactgaaataattttccttccccactgtgctccagggtcaccctgagtcgggcaattgtgctccagctgtccactttcaggggtagcaggagatcatgcagctccatcagtatgttcagctgaagttggttcttcctcagttggtgtaagagacaccttgagaagccgtaggcatggctcctggggtcgggggaggcagtgcctggtgagttggagacacctgctcaccttacatgtaccttacagacatgcctggacgccgtctctcatgcaccatttccatttgacaatacattgctgctgcccacacccaatctaccctgggtctcaggggatgaaaaggggtcttctgggtagacagatgtggtgagggaactccaagttggagcacagtcacgttgcaaaaggacaggggtgtgggggcctggtttcgcgtaagacctggctgcaaagttggacaatgaagactgggagccagatgggcctgttaaaatccatccaggctgtggcaccatcatctggacagttaggtatgagggggatttgcagggggtgcggctgggttcaaatcaattcggttcaaatcaattcggacctcttggccagcccttcagtttgacagctggggacaagggacactaaactggagtttgcctgtggtcctgcctgggagcacagggatagcctaggtggagacaggcagggaagcctgtggccacctggacctcttgctcaccatctctgttctcagtagctccgtctcagaaatgagaggtagcgtccaccccatcagctgacccccagcccccactgcagtcatttgaaaccaggtactacaggtgggccaggaggtcagcttttgaggttttgtgagaaaaacattcatacctgctactccctcatggcaccagagaaagtggaatattccatttgtacccaataaaaatacaccagcgttctcatcctaacacaccccgctgaacactctccctggagagcgagatgagcaacctgctggcctggtttgctgagcaggacggtgctgggtacatgcatgaaggtgcaggactaaggatgacacacccccgggcgcttccaaccacttggcagtttgcctcatataggatcccagtctcgtctcagaataagagtgatttcactgaaatttgcttggcttatcctccagtcaggccccagcagcagcagggaggtgctgagccatgctctccttctcccgggctctgtcctggcagctacatcacaactccaaggagagatggctgagtccctttccctgctggagttagggtggtctctgacctctgccttttaattctgggtgagtcaggaggataaattgaggggtaaatctctgtgtaatatgagctcaatttattgctggtatgagtcacacttaggttgcatttaggaaaaaaaaagtaactggagagtgaaaattgaattagatttctagaaattcaggtaaaacaagagaacaaggatgcaaggaggttgggtccgtgagtggcgctgagcagggcaggcgaggctctggcctgtggtcagggaggccctggggaccacgcacaaacttcgagcaagagcgtcaggaagcaagtcaggcagtgtgggcaggatggatctggagaacctggggcgctttaatttcacccctcagctcctaaatgcagcctcaccagagaggggagaaggaaagtttccagatcatctgctgtgttccagtccccttggtagatatttccatatttgataggtcatcgatatggtttggctctgtgtccccacccaaatctcatcttgaactgtaatccccatgtgtcaaggcaggaacctgatgggaggtgattgggttatggggatggtttcccatgctattcttgtgatagtgagtctcaaaagatctgattgttttaagagcggcagtttttcctcattctcaaacaccctccctcccgcagccttgcgagggaggtgcctgcttcccctttgccttccaccatgattgtaagttccctgaggcctcccagccatgcctcttgttaagcctgtggaactgtgagtcgattaaacctctttcctttatgattacccagtcttaagtcttaggtagtattctttatagcagtgtgagaacagacaaatacaatcatccttgccacagtgtctcagttgcttcaatttaggtattattcatttctctttggagtaaactgagggaaagagaggaagtaacttatctgtggacacaccagtttcaggtgaaggggccaagatgacatccaggtgtgtttggctccaaaaatatctctctgcacagctccaggtggcgccttctccctctctctctttctctctttctttctttgtctctccagtattccccaaacatttgtatggacctggaactctcattagtctttttccatctagacctcagggtgacttctccctggacatacctcttccttctctactccttctccaaaatccatcacttggcttaagttggcagaagacacgttcctcctcctccgtgtggtcggtgtgctagaaatacaagcttcctacagttccctctaaatgaatctctccttttaatctcttacatggcccatcatcctgagttctctagcctggagatggataatggatgcaggtgtgttgagaaccgcttctcagcacgttttcatggttggctggtacctctgaatgcaaggtggaggacgtaacactctgagttcttggccgccattctgggagaggacccgtcccattttagtatgggttacacgcacatttgtaccaagttcccactagagcaaactcctccatgctggaggatggtgttacttcatgttggtttttattctgtgtcccttgttcacacagtggggcattccagacagggaggcctcgatctgagtggctggagggttgggttgttctgagcacaatcttgtaggcaggagggggcctgatgcttctgacttctgagcccttgttttcagagagcacaggtagtattgttcagcgtcccagtgtgaaaagtatttttaaatgtactgggtgaggagtacaattgttattcagacacagtctattttcccccttgaaagactgcctctgaacactgagttattttcctgctctttttcagtaaatcaaaggtttcgccatcatgtaaacccttgggcgacagagtctacctgtctccccctgatattgttctatgagatttcgatgctatcttcattgccagcagccctgacaaagatgcactgcagacggatagcctctcaggtgagattagattgaaccctccttatctcttcattgtggtttcatcactttcaggagatgctctgttgtgagaccttgctttgttgttgctgttcttaaagggaacactccctttgttaggaaaatctgacagctggaagccgtgagttcttggccccttgccctgaagcaagagtgaccaggcctctctcctgagggaaggccttcccaggtggggacataggccctaaagtgagaactgaagcattgtccactccctctttgatgccacatgcatggacggttcagtgaatgtcgtgggaactcagctgtgcccacccctgctttgttaccccggcactttgggaaacagcagagtccagcagaaaccactgaagttttgggctcggagggattccagttcaagccccggcttcaccacctacaaggttcaattttggtctaggaatggaacttctctgagtcttagttgctgtcatcaatattattttactgtcatcattatttatagtaaaataataacctctcagactcgataagtctatttgcgtgcctgacacagtgttatgaggttattatgccttatttaatgccaccatcccaggtgggtaaattagtatcattccatttcatagttggagcagctgaggctcagggagattaataatttgtccaagaccccacagctaacaagtggtggttctggaaggaaaccagggtggctgctccaaagctgccatcagcctgggcatctgccaaggtgccgtctctactggggcagccgccacctcccagcacctggagaaaatgtagcaggctagtgagtggggtgggaggtgggcccgtgtggctcactccatgcatgaaaaacccgtaagtgacaaatgcgtacgaagcagcgcttctcagccagctggccgtcactgtctgcagattgcctggcattcgccttctcagaagaatgagtctcagacctcagggttctgaggttctgtgttgatgtggtggctcagctttgcttgggaggtttcagaggctttctgtgagctgggcattgcacacttggcgcctgtttatgtatttaacacttgtggaaatcctttgaggattgaggtcgctggtcctcccttctgagtgtgacctttggggtgaatttgctccagctgttttcaaccttgttacaaagccctgcagggagaggctgagttcagtcagtcccggagggaggggagctgggggcatcagggatgggcctggcagagcagtgggtgtggaggggcaggtccgggggaagccagtgtggggcaggaggctgggcacctcagggctcctcagcttcctccccacccagctccgggggatgcctccgtggcagaactcctgggtatgctcaggacctgctggagtccagagaggccggggtggttttccagtctgcaaagcccatcctgaggtggagactgatgcttgagattctccacagctgaccttctccaaggtggctggggccattgagcccctggcagggcactgggggcctctatgggctgaccagctctgcacccacctcgctccacccctcagctgtgccttatcaggacaaactgctgctagctcccgagatgtccttggatctgtggccttctcgccccacactccctattctggctgtgtggaaccctctccccatcattcctcactgggtctgttcctcctcctccaagtcgctcatggaacaattatctacggaatgctcactcatgctggtcatcagggtgcagtagcagtaacgcaagcagctgcctccagagcccaaatcctccaaagctcctcacccagcccagtgcctcctggctgcaggtagggccagggccagctcatgtccgtaccccacagcgagccttgcttggagcctgacaaaccctccatgaaggtctttgagttgaatggggctagtccttagcaggcaaccccctgctccttgagagccacaccattctctaagctcactctctgcagccaagctctgccgaagggctagaaggatggccaggacccatcccagatacccaagtgatccaacaaggctcctgtgggaagtggggctgggccaggggatgcttttgcaactgcaaactcaatgtgcagctatgtcttggcaactcctgcctgatgctgcagagccccggcatctcacctgcccctgcccagtctctactttcttcccacatggacctctgtgtgtggcatgtatatgtgagtccagacacaagcgcgctctctcacagcacctgtgctgggcaggtagcaaaacctccgaggaatgcgcaaatgccttttttcagctcctgctctgctgactacgattcaatatccatgtccaaatagagcaatgcagttttcccttccttccagccctcctctgaagaagaaagctctttttcctcttcctccctcctcaccattgcttccctcctacgtttaataagctagtgggttacttactgcaaccaccttttgtttcctaaccagaatcaattttctttgcttttctctgttcccattaattgtgattcataggaacttaaaaggctctcatagcagcatttatatttggaagctgtaaatctcagaaagtaactttctcttgggatacatagacacacacacatcctccctgacctgcgaacagcactttagagattacaaagccttttcacagtgactgccacatttgagtgtcccctggccccaggaggggtcagggcagctattcttctcattttctaaataagaagagagacctcttgtatgtggtggcacaagctggggcgtgagcctttcaactccctgctttcctccttctgcccagaaacccggccgagaattagcagcggggtagagggcttccagctgaagatgggatccaacttcctccctacttagttccttgagcgcagccaggagcctctgggaatatcacacaggtgaccatttcagcagcagagctaggactctgttgaatggacttgaggaaatggctcctgctctgagaatttgcagatgtaacatgaccatcaacctgcccagcccaacatgactggacgcacgccacatccctgaggtggtcaaactccttcaaggactatcacagccttttgtggaaacaggattggagaggtcaagtcttttctctgaggtcacactacagctgcatctcagctcagccttagggcctgggcctgtcctgctctggggcccttgcccttgaagtgcagcttggtaaccagtagcacagggctctcctccagctgtcccctcctgctctggtctgagctggtctttttctaccacgtggaaattctggcttgcagattccttcctgcagcagtcctctgctcggagccctcagccactctgctgctctcacaaagaccctctgggcagccctgagagatggcaacccctccagaggaccttccctctcccactggactctggtcatcactggcatgtgcgttattcattgtcaggcctgtattcacccccactgtctgtgctgtgagctccagatggcagggcctgagcccatcgctacccctctacctttatagggctgtttcatatacgaatgagttaatatatgtgtatcagtcagggttctccagaaaaacctcttgctctatctatgtagtgagaggtctatctacatatagagagaaatttattttaagaaattggcttggctgggcatggcggctcatgcctctaatcccagcacttttggaggccaaagcaggtggattgcttgagctcaggagttccagacaagcctggccaacacagcaaaaccctgtctctacaaaaaacacaaaagaataaccgggcaggtggcacacacctgtagtcccagctacttaggaggctgaagtgggagaatcacctgagctcagaagcttgaagctgcactgggccatggtcatgctactgggtggcagagtgagatcctgtctcaaaaaaaaaaaaattagctgacaggattgtggggtggcaagtttagaatctgttgggcaggctggaaatttgaagaagagttgatgttagggtgttgagtttgaaatctgcaggctgaaaactcaggcaggcttcctatattgcagtcttgaagcagaatttccctttcttcaggaaatctcagtctttgcttttaactccaactgattggatgaggcccacctatacgatggacagtaatcacgttactcaaaagctactgatttaagcactcagcacatctgagaagtgcctttaccataacaccaggactggtatttgaccaaagaactgggcaccgtggcccagcaaagtgcacacataaaactttccgtagaatagtgtgtggtgaataggacacattcaataattgtagcaattattagctatctgcaagtgaatactcagtttctactgaatcacttaatagatttaatactttttaaagagttcaaagaattattttttgacatggagaacctgatacaaacttcccaccatgttgcatggcatttcagaacattcgaagacttggtgaaccacagggttccatctgggtaaagaactcattaaggtccccctggttttaatttctatgatgtcgttattttattagtcttcttaggcaaaacaaaaaatgttgtttgcctttttgtaataaagtaacacctagaaagccatgagattatgagcatatttgaggatttctatttggaatcattttatattcatggactttaattggaaagcgtgcagttacctggctggaggtttatctcagccggcttgatacattctctgtgattatgagtgaggaagctgcctggagaaagcctatttttacataatgcagtttttcatggtgtttttgttttcacaaagataaaataattgtggtgaagtggacagagagactcctgcctttttatttttctttttcaggcttgttgtagtagactcttaaaaatgtcaaaacaaatcaccaattttggtatgtttattatactttttctcatctttattgagagaaaacacttttttttaacctgaagaattacatgggtaaatttccacaacagatgtttactaagaaagtatggtgctgacatattctagaataatggcttttactagatgagtggttgatggcacttggagttggcatggtgaaaatgggcctttctaaccagtcagatggtcctccaaaatgcacagaggcaatttgggaattatttaatattgttggaaccattgtacacttagaataaacaaatgcttgcttaaattagacaaattttatttttttaccagtcatttgtggaaatttcataaatacatttcacacatctgggtaacttcctcattccaattatattccttagctcaacgtgaagcctttgcatgactcaaactcctttgaaatggacagaaatgcatcattactctttggaaactttagtagtccctaggacttgtacagaaacgagcaaattctggatctgtttcagtcacaacgctaaagagtgaaataaaacagtgaggaattctggtggggcttgaacaaaagaagtctgaaatttctaaacactatacttggattcaatagttgaatttttatgctgtgcacattgtacattttgtaaatatgtctttaatatgatttactgaaacacagcctaacaactgcagaggatacaggggactggacatactgagcaagtgctgtgctttttctcatttgttaattttagtatgtgctattatgtgtacatttatgagaaatctcaaatcacttttttttttgagataagagtctcactctgtcacaaggttggaatgcagtggcatgatctcggctcactgcaacctccgcctcccaggttcaagtgattttcctgccttagcctcctgagtagctgggactacaggcacgcaccaccatgtccagctcatttttgtatttttagtaaagacagggtttcaccacattggccagtatggtctcaatatcttgacctcatgatccacctgcctcggcctcccaaagtgctgggattacaggcgtgaaccactgcgcctggcctctcaaaacacttttataaagggttgatgctgcctaaaaaatacaaacacaagatacacacaaacacacacacgcacttctatagacagtcttaatgtgaatgccaggagaaataaaatgatccaacacaaaatatgtttcatgttttgcacacattagatgcccaataatcattatcaatcacagaaaaactgaagataccagttgaatatttgagaattgaaggatttctctgtgtggtaaaatgaggcatatgttatttctcgtgtcttttcatccgaggtgtattagcgttctccagagggacaggactaataagatagatgtgtatatgaaggggactttattaaggggcattgactaacaccatcataaggtgaagttccacaataggccatctgcttggctgaggagcaaggaagccagttcaagtcccggaacctcaaaagtagggaattcgacagtgcagccttcaatctgtagccaaaggcctgagagcccctggcaaaccactgctgtaggtgtaagagtccaaaagctgaagaacttggagtctgatgttccagggcaggaagcatccagcatgggagaaagatgaaggccggaagattcagccagtctagtccttccatgttcctctgcctgcttttatcgtagccgcgctggcagctgagtagatggtgcccactcacattgagggtgggtctgcctctcccagtccactgactcaaatgttaatctaacacccccacagacacacccaggaacaacactttccatccttcaatcaagttgatgctcagtattagccatcagaagtccaccccttgtcaccttgaacccatacacagctcctgaaatcatacataatcttcaaataaagacaataataaattcataattacagctaacattatacagctatcctttgtacaacggaaacatactaattcttaacctaagtgctattacataaagttaacgacacttaaatgctgatatgaagtcagtaaatcttatgtgataaaggaaaaaataaaaacatattttcttagtataagtgtatacacgaacaaatacgttcttaaaataaggaagaaatactcatgataattacagttgtcgtttctgcagctggtcatgtggtattaatgactgcttttttctactacccattctgtattccctttgccttcagcaagcacttcagcaggtcgtgtttttttttcttttaacctggtggagtgatgcaaaccttcattgcttctgcgccatttgccatcctgcctggattgggttgttgtagtttcctgttgaccttaatcacagggcatggggaagggaaggaagcattttcttagatacctggaggagacagcaggcgttgtaagattaaaactgtgatattgggactgtctcaccatcatcatctttgcttctctatgggatcaagcccaattctttgactcctccttttgctggggacagggactccgacagcactggggtagcatggtacagctcacgagcagggaaaaacacacctgtttctccagtgtgtcatgagactagaggaggcttcctgtgagctgctttggtcacgtgtctaggaggaatatggtgttatgacggccagcatgggtcccctgcatgcttctatggaccattgagtagggaggtgacacagtgaaattcacagtcctggcagaggcactgttaccagaaaagggatcggatcccaaccctaagagagggttcttggatcttgcacacaaaggaattcaaggtgagttgtggagtacagtgagaagagatggtttattaaaaactattccattacagaggaggtcatccatggaaagaaagaagaggaatgcaccatctttgtctgaaggtttccttatgtaggagtcttgtctatgtaaagactaaactaagctgtcctatatgtggatgggcaggcagcatgacaaaatttagtagtttattaatgtaaagaaaactatccttgacattctagtgtgtaagtacatcaaagtgttaccgtaattatcttgaaagcgtatatcgttatgggtattgggacatctgggttttctgttgttggaggggtttgtccttgtaggcattagcaagctgcttccttagctgtaaacatctaaggaccatgggtggtgactgaccaggaatgtgccttggcgagtttcaagatggaaggccaggtgcggtggctcacacctgcaatcccagcactttgggaagccaaggcaggtggatcacctgaggtcaggagttcaagaccagcctggccaacgtggtgaaaccccgtctcttctaacaataccaaaattagccgaatgtggtggcgggtgcctgtaatcccagctacctgggaggctgaggtaggagaatagcttgaacccgggaggcggaggttgcagtgagccgagatcatgctattgcactccagtctgggcaacaggagcaaaactccatctcaaaaaaaaacaaaaaaaaaaaagggtacaagatggagctgaacttaaaatggtgtcactctgactctcctgggctcctgcttccataacagcaccaaagcagagaatcaggggcaggaggcttttcggcaaatcaaaccacagatatccccttccctagcacctctgcaggccgcagcagctgctctgtggagagaagtgagttgagcactgaggatctgcaggtaaggagctgaagacacttccctgccattcggggttttgcgtcctataagaagagatagacataaagagttaaacagtgggtttgaggctattttgtttgtttgcttttttgagacagagtcttactctgtcgcccaggctggagtgcagttgtgtgatcttggctcactgcaacctctgcctcccggattcaagtgattcaggcacgacccaccatgcctggctaaattttttttttttttgtatctttagtagagacagagtttcaccatgttggctaggctggtctagaactcctgtcttcacgtgacccgcctgcctcggcctcccgaagtgctgggattatagtcttgagacaatatgtcggcccaaaggctattttaaaagactccatgagcaaaaagacgcaaggaagagaaaccgggtgagctgggaggtttgctcaaagagcaatgtgactccttggcacctgcagggtgaatggaggtttgagaggtgaagaaaataggtacattgttcagggtggggatgctgtgctgtggtgacaagtaataaactcttagatgcttggcacaaaaaagaatggatccgcttatatcatacctctaagtagtttgtgggtaaaggcagtggacagtcctctatgcagctattcagggactggggctccttctgtcctcctgggatggagctagtctcaacacacagcctccagggttgccatggaaggggcagagggaggaggatggacgtggagctttgttgtaaggcaggccatgaaagactcatattatttctgtcctgttggtcaaaggtgatcacaaggccccacttggatgccctgagtgtgaaatgtgttcttcctgtggacccagtggcggggacggtagaatttagacatgtgctgagcacttggcattaggtctgaaaaagtcaggaagagcatttcaagcataggaacaaatgaggcaaagactcagaggcacaaaagagccagatgtgtaggtggaaccctgctgtgctgatgtggcagatggtaattgttgaatgagaaaaaaggaagacggactggaggaggaggagggtgcaggaaggtaacagaccctgcgggcttttcctctaggcagtaagtagttggcaacggaagtgttggagcagaggaaggagtggcttgttttgatctaaggatgagaattctggcggcaaggtatgaaggagaaggttggaagtggcgagctttttaggagcctaacacagaagttcttgtaaaggaaaagggtgtctggatttggggtataaatccagggaccatggggtgaacatgagcagatggctgtgaaaactttcagttcgggagacaaattggatgctggaatgttccaggaaagggtcactgtggagttacagaagaatggataaaataatgtgccctagtccttcatccccaagaagtaccaagaaaaaaaaatagcaggaagatactcagaggtgatgctgattagcggctatagccattgacccaagatgaaaggacgagtttgatcttctcaggttgctggtatcttggcgctcctgcatccgcttctaactcgcggagatagttcatcatttcccacggcttaaagtacagtcttcatactgccgactcctgaatgtctgtgtttggctcaggtctctcccatgagctccaaacaggtgtttgcagctgcctagtagaaaattccacttggatgcctcccaagtagcatcaactcaatctgtcacaaacttatctcagagactttccttttaaacccaggctcaccttcctggagaaatatcccccccgcttcccagttgcttatgccaaaaactggagagcgtttttcatacgaacctccccttaaagctcatattcaattactcaacacgatcaatatttccttcccaaatcttttcttccacggttcttctctccatcaccactgccaacaccttactctaagccaccctgactcctcactgcagcaaccaactctcgggccacttcacctctgggtctccttaaggtattttctataatacagccaggaagatctttttaaaaatggaattcaacaattcaaatcatgctattcttgtcttataatcccttaagagcttccctttattcctcagttaaatctcagatttgtagcctgccctggaatgtcctgtctgacctggccacgctaaattttcctccatttcgctccatgatttcctctggatgcggcgccagcaattagctgaccttccttcctttcccaaatgggccaggtccttccagccttatatccctcgcataggccagttcaaccgatggcttggaacactcttcacctcccacccagggctccctggcagcgtcgccaccttcagagggctgtctctgactgtccagaccaagacaacacctggaatgctcttccttccttagcatgtcctacttaaggacaactgcaattaaaagtacaggtcaaagttgtgagggaagtctttctgttgagggtcaatgcagtaaggacagggattagaaataagttttgctgtcattaaactctctatttgaaaactatgattgcacataaacgtgtttagtaaatgtttgcattttatattttcggacttaaagcaggactatatagaggtatcatcttggttagaaaattggttccatgaacttcccagtatacccaagaccgtatttcaaaattggaatcttcagcacatcatgagttttcagcctttggggctcaagggaggcagcagagccagggcatgagaacctggagtcaggccagatggcctcattccaaatccctgctctgccaactgtgtgacctgaagaaaatgtcttaacctctctgtgcctcatttattttgtatgtaaattgggggaataatagtatttataccataggttggctgcaagaaggaaataaaataattgatgtaaaatatttagaactgtacttgacatatactaattggttattctgcgttgttagtgttgtaataacgattagaactagtaatcttctattattgtaatcctcattttggctatgttatttaacaccatatatatgtcatcaagatacataaataacaaaacatgaggcagaaggaggttgcatgcaattaaagggctacaagggtctaacattttcttggagctgttaaggtattaatttaaatttgactctaagaagtaaataatgaaattaaattaaaagtatagggaaaaagctagagaggggaaagaagaatgatgaaatatatttaattcaaaagacgtcaagagactagttaaaaaggaaatagaatgtgtggaaaaaataaaaaaaaagtagacacaaaatcaaacatgtcagcaattacttttaatgtagaagaactaaaagcagcaatcaaaatgccaacattatcaggctggataaaaaccaaaacaaagtaaaacctaaatgtataatctttacaaaaaaacacacattaaatatgaaacgttaaaggtaaaatgatggggtaagttacctctctcacaatagtaactgagaaagctggtagagcagaacacagacgaagtagggtttagggcaagaacatttattaggaatacaaagggattgtttccataatggtgaaagagttaacccacaaggctgtggtaaaaatattcaattgctagtgtctaataatatagtttcgcaaaaataaagcaacattcaccaataaaaggatcaaatacataaggcagaagtcatagtggaagatttaacatagttatttcaataatgaataaataagtgaacaaataagaatacagaggatttcaacaaggtcaacacatttggcctgagtgggatacacagaaggctgcctgtagcaatgacgtactcacagttttcgagtgtacccggctcgtctacaaacactgacttcagctgggacagaaagcaagtccagaatttctcaaagaattgacataattttgagtatggacaggaaggtgaccaggaaatgctaaatatttgggatgtaagcaatgcacttctaaatagccatgaataaaagaaaaacatgacattgacaatgaaacagaaatatgttgaattaaatagtaatacaaatacaaggtacaaatgcgtggaatgcagctaattctgtgcttagaaagagacgtatgcccatccatctggatccatatctagatacatgcctatatctagatatttatgcttagatattcatgtctatatttagctatagaaatagatacttgaaacaactgtttagacgtctaaatagagatatatatatgtagatacagaagatttgaatatgattaacaaacaatctaaatgacacatagagaacactccatacaaaaaaagaccagaattcagttttgcatttacctacatacctatctagtcatctgaatatgaatatttaaaaatcaaaggaaaagaacaacaaattaataccaaataaagtaggaaggagcaactaacaataagaagataaaagttatgaaattaaaatttaaaaatacaaatatgcaaagaaaatcaatgaaagcaaagctaatatccccaaaataagataatcattaaactcttagcaaaactaaagaataaaggtgagaaggcacaaattgctaattttggaaaagaaaaaggtataatcactgtagatccaatagatatcaaaaaggcacagggaaaattataaacaactttttaaaattgatatgaaaatttagatgaaacaaacacttctacaaaacataaaacttactaaaactgactacaaagaaatagaatattttaatatttatgtatctattaaattatttaaactaatttttttaagacaaagtttttttttgttcttgtttcccaggctggagtgcagtggcgtgatcttggctcactgcagcctctgcctcccccactcaagcaattctcctgcctccgcctcctgagtagctgggattacaggcacctgccaccatgcctggctaattttttttttttttgtatttttagtagatacggggttttaccatgttggccaggctggtctcgaactcctggccttaggtgatccacctgcctcggcctcccaaagtgctgagattacaggcatgagcctccacacccagcctatttaagctattttttttcaaatctctatgaactcaaagttttacttataaaatggaccaaatataaggaagaaataacagaaaacttttgcaacatcatcttgggaacataagaaaacaccatcaaactagttaataaggtcaacataaacatgtttccaaaacctgacaagagctttacaagaatgggaaattacaggcaaatttctcaaacttagatgaaaaattttaagcaaaatattagtaacccaaatatagcaaaatctaaatagtacaatataacatgaagttggatttttccatcagtgcaaccttggtttgctattcagaagtcaactaatgtagttcaccacagtgatagaataaagagaatatcatgtttgatcatcttgatcgatgcagtgaaaacattggataaattctatactcactaaaagtatgaagtagaaagctatggttcaaagaaaacatttgaaagcaaatacattgactccacctaaagtgtacaccaatacttctgcttcctgtggatggaatatcaagcattagacctaatttctcactataaaagtaagtagaaatttgaaaacttaacatttgaaacaactctttccaaatattgaacaacaggcagcccaggactgtgattccaaagataagagaagtaaaggcttgtctcgcatgtgccatatttcttcccgaagacaatttctgctatgtggatgtcgtaatgagaaatgcaaaagagtctgggagtgtcagaattaagtcagtaaaaggctgaggcatctaaactttgcagagaagtgctatagaaaaaagcagaaaaagtgcccaggagtctatatgggagtcaccgtgggtcttggctgagtatcagtcatgcatgcatagagtgcaacttcatagagccaggcaaaggatccccgaggacctattagtttaacatttctgagaacccacatccgagaggaagatattcaagttccaaccagctagaagggagggcctcagaggttacctggggtagtcagtggaaggctctgtggagctacaccttagcagtcaggtggaactatccccatactgaaggttcctctccaccttccccagcaaagcctaaaatggaaccggaatggatcagactggatagcagataacttgattttctgcaaagtagagtaggcccaacattctcggaaggaaaacaacacacacatcaccatgtcaggcattcaaccaaacgactaaacatcccccaaagccagaaaatgtgacacgcaatcaaggaaagagtcaataaatcaatcccaggcactacaaaagtgattgaaaagttgaaaagaagcacattaaaacacctaccataaacatacccagttatttttaaaaaagggatatataaaaatgaaacaaatcttctaaacattaaacatgtatctgatatgagtctttcagtggatcggattaacaatgggtttgagactacagtagaaaatatcagtgaacttgaagacagacatagaatgtatgcaaaatggagtaatgagaggaaaaaaagaaagaaaatgagcctaattgagctaggggcaatattaagccatttaacctacgcaaatttgtactggagaaggggcagaagttcaaaaataaatttgaggtaaaaagggccaaaaattggttaagtttgatgaaaatgataaactttcagatgaaagaaggtcaatggaccccacacatgaaaaatacaagtgtgcatgcatacacacatacacaccaagacatatcataataaaactgttgaaaaaaacagttataatgagaaatagcttaaaagcaatgacacaaaaggccaataaaatatagagcaataaagataagaaaatcacagatttctcatgaaactgcaagctagaagacaatggaacaacagatttaatatgcaggaagaacaatgtaatctagaatacaatctacatgcagtgaaaatgccctttaaaatgaaggcaaaacaaagactttgtccaagaaagaaaagccgaaagcattaataatctccagcagacccacactaccagcattttattgaaagttctttagaaggaaggaaactgatactagaatttgacacaaagaaataaagagcaacaaaatggtaaatgtgccctaaatttgaagtattttttcattgtattaaattttattaacaagattattggctttttttttctttttttcttttttgagatggagtcttgctctgttgcccaggctggagtgcaatggcgtgatctcggctcactacaacctccacctcccgggttcaagtgagtctcctgcctcagcctcccgagtagctgagattacaggtgcgcaccaccttgcccaactaatttttgtatttttagtagagacggggtttcaccaggttgtccaggctggtcttgaactcctgacctcaggtattccacctgcgtctgcctccgaaagtgctgggattataggcatgaaccactgtgcccggctgattattggctttttaaagcaaaaatgtggggtttgtaacatatggaagtaaaatgtatgacagaaatagcataaggtggtgtcttcgtaagtatgtttacataaatgtgcaagtattcattaaagggcatattttgatcatgacttttctgtatgctgtacataaaaaactttgcctaaaaccaaaaagaaaaggatactgcagtagattgtcttactatttaacaatatgcatcctaacgttctcacctctctgggaggaatttactttatcgatatattcatggtggatttggccatatgatttcctttggcaagtggaatgtgagaaaacatgacaatatgccagctccaaacagtggctttataatgtaattcaagctcattccacatctcttgagctcctctctctaccatgagagcagcaatatacaggttaaaccttccgtctgcaccctggactctagggaagacctgaaactgacaccaacctagagatgatcagtcagagcatatgcacaggcccaagagtgaaaaatgattatagttttaagtcattgagcttttgcaattgttcattatgaagtattgttgaagaaaaagctgactgatacagaatttagaataaagaagtggagtgctcttgtaacagaaacctaaaatacactgtttcttggtattgttttgcagacagggcagcaggtagcatgggaaccataaaatgaatctgaaaaattacaacctatattgtgcagtagtaaaatatttggcaaagtactagcctgtagtaatttataaggaaaaaaaaatgaggctaggggctgtggctcacgcctgtaatcccagcactttgagaggccgaggtgggtggatcatgagctcaagagatcgagaccatcccggctaacatggtgaaaccctgtctctactaaaaatacaaaaaattagccgggcatggtggcgggcgcctgtagtcccagctattggggaggctgaggcaggagaattgcttgaacccaggaggcggagcttgcagtgagccgagatggcgccactgcactccagcctgggcgacagagtgagactccatctcaaaaagaaaaaaaaaagaaaaaaagagagaaaaaaaaacctaatgaatttgtgactctgggcaaagatatttcaggaccgaccatactagtgccagttaagcattattagttgcatttcacagggctctactaggaagtcataagttaagaaaacaactggccattttacaagcagaaaagaaagagaatagagaaatctgagatgttcttggacttggcaagtttagagaatgggtttgtttctaaacacatcaggagtggtcagtcattaaggccacgaatctcctatcttgttaagatacttgattgggtaaaagtggttcctggtgagtcctttcagttagaataaatgtctcaagagtgtggttcctgagatgccagataagttcaaagtacctcctgtaagatttgaggtgtaaaatgacctttgagacccacatttctaaaggcagaaaggaggagaatgctgtttagccaaccccagggcatagtttccaaagccttcttcagggatagttttcaaacgccttcttcagacatggcctagaaagataaggataacagggctgggcacagtggctcacgcctgtaatcccagcattttgggaggccgaggcgggaggatcacgaggtcaggagattgagatcatcctggctaacgtggtgaaaccctgtctctactaaaaatacaaaaaattagccgggcgtggtggcgggcacctgtagtcccaactactcaggaggctgaggcaggagaatggggtgaacccgggaggtggagtttgcagtgagctgagatcacgtcactgcactccagcctgggcaacagagcaagactctgtctcaaaaaaaaaaaaaaaaatagaaaaagaaaaaaaaaaaagaaagataagggtaacagaaggaactctttgaaggagaagccaagagcgatggagaacaatggaatagaacctcagcctaacccaccaacattctttacctgacaatagggaactgtggaacaccagccacctggatttcggaattgctatgggccagtgactgcagggtcctccctattcttccccattccaatagaaatgttcaaggcagttgtcctgctctatgccaccattatttttcagctctgtgagaggaacatatctttgaaaaaaattcctaggtctccagaccaagagaagtcccactgagacctgatgaaaaaattgtaacatttgagctttcaattgccgcacctggattggatgattcttttgaagtgttagggagaaaggaaaatgcatacttgtgactgttcagaaaatatgcactctcttttcccagcactctgctccactcccctgccccagaagggtgtactttcctgcatcattgatattggacttggtaatttgatttattttggccagtagaatgtggggaaatatgacagcatggcagttccaaaacaaggttctaagagactttacaagtctccagtatatattttgtattctaccatacaccgcaagaatatcacagcacagaccgtgtctgattcttcagcttgagtcctagaatcaaaagccacgtggagcttgcctgaacttcacctctgcctggagctgagaagttcatgtgaaataaatgtttgttgtttcaagctactgagattcaggagggtcagttgttaagcaacattactgcaagaaaatctgagtagttcttccttatctatgggaatatgttgcaagactcccagtggatgcctgaaactgcagataatacagactctacatatactatgtttttttcctatacatgtatgcttatgataaagtttaatttatagattaggcacaataagaaattaacaataaaatagatcagttatagtgatctactgtaatgaaagttgtatgaatgtggtctctctcgaaatctcttactgtactacaccctctttttcttgtgatgaggtgagatataaaatgcctgtgtggttagagaaagcgagtgaatgatgaaggcattgtgacaccgtgttaggctactgttgaccttctgatgtcgggaggatcatctgcttcaggtgatcctggatcattgagccgagacaatatccatggttggatggtagcagcagacaatgtcaatgactgactggtgggtagcatgaacaagctggacagaggggtaattcacgtcccaggaggcataaagtgggacagtgcgagattccaccacgctactcagaacagtgcacaatttaaaacttacgaagtgtttatttctgaaattttccatgtgatatttttgggccatggtaactgaactgtggataaggggtgactgcaatagtacaggtaaacaacaaatggtgctgatgagaatagctagtcgaaagaaataatcctggctcaacactgtgcagcaaaacatacacacgtgttaaaaatggagcatgtttaaagcaaacagaaatgcgagtaaaatatggatgcaaataaccagctgatatcagagtataaaaggcatttgaaaggaataaattatttcaagaaatcaaggagaaaattaaaataggttagcctcaaaatatttaaccttctgaataattgaaaaatattaatgaaattaaaattcacaaatcatggaaatgtttctgaaataagtatcatctaacccatgctttagggaacatgagaacggaagaggtaaaatcactttcaggtctgtatgcagagggtaggtagaacctaaaactgaggtccatgctctgtcagcagacatcaggataattattaatagaagcaaaacacctagtacctagagactagtcctcatccctgtggctcacgacaaaggttcctttaggttcctgatgtactaggcactcaactgtctttttgacagggaaccagagttatcatatattaaattccacatatgcaattgactgcccagcacaaattacacctttcagaaatgtcattctgttgaatagtgaaaagctattcccagggtggaaaacattgagatttgttattacagacagggattggaaaacaaaatattgtgaaattaagtgtgtcagattgtttaagcacaacaaagatgataccagaaatctcattcattgtcattcaaatctccattttcaatggagtctagagaagagcaaatagctaggtacaaactccagttaccccagactgaactaaataacatatcctgaacaatgagcccatgggaggtatttgtgaaatacttgagaacctttcttattgtgtttggtaactttgaaaagcagatgatacagcaagcaccactttactttctctacattaacttagagattttctcccatgggcttgaagaatgagaccctctgtgcaatctggccagggccctggaaattagcatctactgtagatgacccatgggccaaggcacgtgggagcccataggatggagggaaatgagaaggtgaggcagagattctgcctcctggtgttcatgccgttgtataatcccttcctcttcaatgaggcaaatacaatgtaccagcaaatagaatatggcaaaagccatggagtgtccctcccaccattctaacatgggtatgcaaatctccgtcttatccttagaccacacgctttctttgctggctagatgaccttagcaaccttaccggggaaacccatgtggcaaggagctgcaggtggtttctaggagctgcaggtggtctctaggagctgcaggtggtctctataggagctgcaggtggtctctaggagctgtgggtattcttgaggagctgcaggtggtttctaggagctgcaggtggtctctaggagctgtgggtatccttgagaagctgtaggtggtctttaggagctgcaggtggtttctagcagctgcggtggcctctgggagctgtgggtggctccaggagctgcaggtggtctctaggagctgcttgggggcctccaggagttgcggggggcctccaggagttgcaggtggcctccagcttacagcaagcaagaagtcagactgcagtcctacagtcacaagaaacggatcctgccagtgttctgagggaggttgaaagcagattcttcactatcccggcctccaggtaagccccagctctgactgatacattggttggttgcagagttatgagaccctaagcagtcatggcccagttcagccactcccggactcctgacccagggaacctgtcagatggtgagtgtgtgctgttgaacccatcaaggtcgtggtggtgacgatgtagcagcagatggttaatacaaaagggaagagaagcaggagacccggcaagaaaggaaagggtggggcagggcagaccaatctccttttttgcattaaaattaaaaggcctgtgacttaattttactgtgagtgagatgaggattttgagcagaggagtgatacgatctgatctctatgtattaagaaacactgtggctctgtgacagggacctggctgagttactggggaaagaaatgctgggattctggatctactgtgaagggagggtgaagggtatttggatgatgccttggttgtgggatgtgaataataggaaagttgcagttgactccaggtttttcagtgtgagccactggatgaatggatgggttgccttctactgctgtggtgaggcggttttgagggatgggagctgacagccctatgtggggcataaatggccatcccagtggagatgacagccaggcagacccactgtcaggactctgcagttccaaggggaggtctgggctgcagacgctctggggttcccgaagtagaaacgtcgcataaaggcaaggtacagtcagtacttggggaagtgtagctatgagcatgcaagttgatcctgagctccttggaggacggtggaacatgctgacaccacaaacagagttgaaaaataggggtctcatgtgcatcccttttgtcctgcttggtttcggtgtgggtggaagtgtgctctccatggaccgcaatccttgaaaattctggcttcagttttgctcaccagatatcacccctctcctcaccatgcctgtcttcccaggagcactatttcaatgagaagctgggagctcagaagctgagcgggggatgtatcactcttaggtgaaagaagggggaagaaaaaccagaaaaggtcctctttgccccaagtgctttgcatgcattaaatctaaggagacaggtgtctttaaatctggattcttaaatcaatcacttgctgccaacatgcttccgtgttcaaagtcagttaccatgcgatgcttctgaaaatagacctgtgctgaccaatcatgactcttatataagatttagtactgacttaagcctgcaccagccaggaatgtgatgtgacaagctggatgggagcaactcctggtgatggatttccagccaaatgagaggtgactctctgggtacacggagagcacacctcagcaggcagggcctggctctggggagagttggtggcatggatgcacagagcttcatggggctctcatgagtcctcctgagcaggcaccaggaagcctgttagtcgcctcacagcttcgatgtgggctgtggccagtcagaagcaaggccagcagcaatgaaccaggagagagcagaaagcccctaccggagtccagcttggtgggtccattggccccaacaaatggctctccccagccacatcctgtccaggactatgccagggtcgtaggttgattccctccttcagggccatgggaacatggacaggatcaggaaggaagttagtcccatgctccttgctgaccagaggaagagacatagaacattctccaacccaaatgtgggaggaagcctgagtggggcaccctcacagcctctgcaggtagcaccttggccaacctccttctgcagagacttccctgtccttgtgccaggcttgacactgaccaaggcaggtggggcagaaccaccccaggccatgctgcaaaattctacaccaaacgtcccagtcctgttgggtcagccagccctgagttcttagccccgaccactgcacctcccccgcagtgcccctcaggtcctctgccagcaggtgccagcaggatgtctcaagtgcagctcagatcactgtgctctgcctaatatccccacttctcctgtgttgggtcctgaatgccttgccttctccttgggcagaacactgatccattcctgctcaccttggaggcctcaacatgcacagcttcaacttcaacatcttcattttcatcttcttcttcttcatctttatcttcatcttcattttcatctttattttcatcttcttcatcttcatcttaatcatcttcttcttcttcatcttcatcttcattttcatcaccttcatcatcttcatggtccacatccagccacctggtttaccagagagtgtccccgaatgagtcctgccctctcctgctttctgtaattactgaatgaccccaagtgggttggttgatgtctctgggcctgagttacctctttttactgccgggatgattgatagtgtgtaacttccagggttgttttatgatatgaattagaaataatgactgtagggctgggtgcggtggctcacgcctgtaatcccagcgctttgggaggccaaggcgggcagatcaactgaggtcaggagttcgagaccagcctgaccaacatggagaaaccttgtctctactaaaaatacaaaaaaattagccaggcgtggtggtgcatgcctgtaatcccagctactcgggaggctgaggcaggagaatcgcttgaacctgggaggcagaggttgtgatgagccaagatcgtgccattgcactccagcctgggcaacaggagcaaaactcagtctcaaaaaaaaaaaaaaaaaaaaagaaataacgactgtaaatactgcttagcctagtgcttggcgtacagtaggaactcaatgaaagggggtcattactattggctgctcagcccccctctctgctgtatgtggctgcctctttatttgtactttagtacttggcttagagaaatcctcctgcagggaggcttctctgatttcatgagactgaggtgggcttctcccatggcctcccacagcctttgcgcctctctcttgtgcagtccaggtgacatggtgtcgtgattgttcactaatggatcagtcttctcaccacagggggctggagggcaggggccattacttttaagactctgtgcaacacgctgatcagtcacaaaatgcatgtttgttgaatgaatgaaagaaatacagccagctgtccctgctcgatgagttgctccttggttgacctttcccctatgacacgacctctgaggatttatgccgatctccagacgtacaggatggttcacctggtttctgctgtagcaaacatgctgctagctggagtttgtttacggagagactgtcttagaaggggagtctctgagtggacacagctgaattgtggacctcatttgggtgtttccttcattcattcatcgatcctctacagaacataaaatttgagtcagtgtggtgcccagcacaaagtgagtattcaacgggttttgactcggtccaattcattcctgcttttataattttcttttttttgaaggtggagaggcgggaaggtccccagtgtgttcatgggaacgcagggcatgcctcactgcctttggacttgccgctccctgggttgggagggagacctctctgacagatgcccaccttatgttctcagcgacatttccctcaccattccctctaccccttttttttaaaaaaaaaaagagacataactcatatactgtaaaattcaccatgttacggtgcagagttgggtgggtttcagcggatccacagggcagtgcagctgtcacttctctctatgtctggaacattcccatcaccccagaaaggaaccctgttctcttaagcagcgtctacccattttcccctcccccataatcctggcaaccacaaatccactttcggtctccatggatttgcctctcgttgacatttcacataagcgggatcattctataagtgagcttttgtgtctggcttcttccactcagcatcgtgttctcaaggttcatcagtttggaccaggtgtcagtgcttccttcctttttctggctgagcaatattccgttgtgatttaagggaacatgaatacacagcattttctttatttactcctccattgatggacattgggttgctcccactttttggctcttatgaataatgctgttatccctatttgtattcacatttttatatgaacacaggtgtcagtatctctgtgcacattgtagtgtgacatctggtaacttcgtgtttgacatttccatgaagtctccaccaaggctgcaccatttttccattcccaccaacagggcgggagagctcccgtgtcttcacatttttgtcaatggctactattttctggatttatgtatttacttattaattgtagtcctcctaacaggcatgaagtggtgtctcattgtggttttgatgtccactccatcttaacgggtaaacttgctctaactccttacccaaatctctaaaccatttgtcaccctctggatttgttcatctgtccatccatccatctgcacacacatacacactgtatacacatacacactgcacacacatactgtatacacatgcacactgtgccacatacacactgtacacacatacacactgtatacacatacatactgtatacacatacacactgtacacacatatacatagtatatacatacacactgtacacacatacacactgtacacacatacacgctgcaacacgtactgtatacacatacacaatgcatacacacatacagtgtatacacatacacactgcacacatatatatactgtatacacacactgcacacacatacacaccgcacacacacactgcacacacatacatgccacacacacactgtacacatatacacaccgtatctgtgtgcatcaggatacatcaggaatgcatttctctggcccctcctctccactcaggcccctctgcaccttgaccatcccatgccacatttttccactttgcattccacattccagcccatcagaaccaccaacaattccacacttatgccccattgaagtctgaagatgcccaccctgtgcttggctcatcattaccccccaccagcctgcaaagctcctgcttctccttgaagaaacatctgctctggccatgccttgacaaagtggggacctgaccaccaaggagggaggggaggaaggaggacagcatttatccatcatctgtgtctggccccatcccagggggatggagtgcgggcagggttgcagtaggaaccctgatcacaccttggtcttcaggctcttgtgggtgaaagaggctggcacgtacccactgaatccaggcaggtgttcgggagtgggcaggtacactcagcctgaaatgatgggtgtattttgcagaaaccaaaagggatccctgttgggaaaagcctgaggaaggtcgggagaggcatggggcgagctgcagatggttggaggctcttggggagaagttgtgggctggtcaggtttgggagggcaggacatgaggttggaagacacgtgtctttgatctcccaaatgtgtgttctgagctcaggccccacgcacatggcttcccagttgacacattcctatttcaacatgaatattttaataaggcagaaactttcatttttctctctttttaaaatcaaatccatttcttgtgatttattgatttttttttaaagtaaatcaattttttcgttttcacaacttattaccagatagtggggtctggaacataccgagcaagaattctgttaaaagtatttaaaagtattttcaaatcaaatcgataaaactacatggatatgttttttaatattacaaagaacaaatgtggaaaagttaatcaaaacatgctatttgacaccaacacgtagaacagcacagctttgatttgaacagatgttctaaaccatgaggactgtgcaagagaaacttaagaaaaataagcataagcctctctgatacaaaaacaagcagactcggttctgggtctgggtaagttgggttaaacacactctccaaatggctacacctagaaaagctggacagaatacatggaacaactatttaaagaccctggaaagcgaacagcagcaggaggaaagaactcccaaatccaacattccaccagattaatgcagtttactctgtcccctacctgatctcttcaagtctgaactcaatgccctagaaacccagaaatggacaccaaggtgcaggtagagagaattccaggaaaaactctttctttatggcccaagtagcaggaaaacaaactcccatcagaaatccccattttcctttttttttttttttgatggtgtctcactctgttgccaggctggagtgcagtggtgcgatctcggctcactgcagtcctcaactccctggttcaagtgattctcctgcctcaccctccccagcagctgggattacaggcatgaaccactacgcccagctaatttttgtatttttagtagagatgaggtttcaccatgttggccaggatggtctcgatctcctcacctcatgatctgcctgccttggcctcccaaagtgctgggattacaggcgtgagccatcatggcaagcctagaaatccccattttcttttcaatgttttccttctgttctctctcaccacaaccccttaagcaatcacgtggagatggtggcagcagagagtgatacgcgcccacaggtgcagggcagtcatcctctccgtcctgcagacctggtgttccaggaggcgaggctgcacctcacacatcctcccctgggtgcttctgagctgcatgaccatggacgaagggatgactgcagaagtgctccacagaacagggtaactcacatcccaaatttccagccagaggaacttgggaaaggctgtttgcagactcccgggctcacggttcccctgtacacacaaagctgtgcacacatgggtgttgcctcatggagcatttcaaacgtcatgaaggttaaactgacggagcactcacagaccgagtcctaggttggcctctggatggccacttgtgggacagatctggacagaaatgcaaagcttggaaagtggagctaaccataaaaccacagccagtccagagaaggcacgttggaacttgtggcctgggtgtgagcaggttagctgcctgcagaaacaaacactgggcattgctcattctccctgcctcataacataccatccagaatgcccaggatacaatccagaattacttggcatgtgaggaataaggaatatcccaattctcatgggaaaagatggtcaacagacaatgatactaagatgacacagctgttgcaattatctgacaaagacattaaaacggtgattattaaaacattccagccaggttcattggctcacacctgtaatcccagcactttgggaggctgaaacacgtgtacagttttgagctaaggagtttgagaccagcctgggccacatggtgaaaccccatctctactgaaaatacaaaaattagccaggtgtggtggcatgtgcctgtagttccagctacttgggaggctgaggttggaggatcccttgagcccaggaaacagaggttgcagttagccgagatcacacaactgcatgccagtctgggtgacagagtgagaccctgtctcaataataacattccaaaaagtcattgcaaacacattcaaaatcaatcaaaagttagaaaaggaaaatttaagtcctgaaaaaagcgtgcatgcatgaacgtgcacacgtgcacacacacatactcacacagaaacctcatggataggctcaatagcagactggagatgagagagaaaagagttagcaaactcaaagacagaccaaaagaaattatccaatctgaaaaacaaaaagttggaaaaaaaaaatagactaagcctcagggacctgtcagagaacaataaaaggtctagtattttttcactggaatcaaattgaggtgagagtgtgatgctaaagaaataaataaatacataaaaatttcaagaaaatttgctgaaaactctttacattttggaaattacctaagccaccagaatcaagaaggtcagcaaaccccagagacaataagcccaaagaaatctatgcacagacacatcataatcaatctgctgaacactagacacacacaaagttttgaaagcagcaggaaaaaaaaaaaagatgcattccctaaagggagaaagcaattcaaatggctgtgactttcttatctgaaaccgtgggggtcagacggaagtggcacggcgtttttaaagttctgaaagacaataattgccaccccagcagtatatatccagagaaaataccttcaggaataaagatgaaataaagacattctcaactgaaggaaaacaaagagaattcattacagctgaactgctctaagagaattcctaaaggaagatctccagacagagaggaaaggatagaaggaatcttggaacatcggaaaggaatgaaatgacaggagtgataaatatgtgagtaaatgtaacaaattattattctctgctttgaattctttaaaatatgtatgaagattgagagcaaaaaattgtaccattgtctgatgatgttttcagtgtatgaacacaatgtatgtaatgcataaggcaatgatcacatagagagagagagggtctgcaggtccccatggaggaaagttttctgttttgttgttgtttatttattttattttatttatttatttattttgagagggagtctcactctgtcacccaggctggagtgcagtggcgcagtctcggctcactgcaagctccgcctcctgggctcatgccattctcctgcctcagcctcccaagtagcggggactacagacgcccgccaccacacctggctaattttttgtttatttagtagagacggggtttcaccacgttagccaggatggtctcgatctactgatctcgtgatctgcctgcctcagcctcccaaagtgctgggattacaggcgtgagccaccacgcccagcctattttatttttatttttaatttttagggtacatagtaggtgtatgtatttatggggcacacgagatattttggtacaggcatgcgatgtgtaataattacatcatggaaaattgggtatcaattccctaagcatttatcctttgtgttacaaacaatccaattatattcttttagttattttaaaatgtacagtgaaattattattgatgatagtccccctatttgttgtcatataacatggaatttagaagtaagcaatccggccctaggatgagggccctgtggtggtgtcaggatccggtctccttcccacttcctgccatgccctcctttaccagtggttttcaggttatggttccacggtggctgcccacctctgctcactgcatctgcatcccaggcaagacaacaggagcactcaacacaaatgtgcacggccatgggaacaggccagccacatattcctcttcaaaaggccctcccagaactactaggcagcattttctccttcctatattgaccggactttgtgatacaagagagaaaagaatttagcgaagtatatttacacactgaacaaaatcagggtcatattagcaaggaagaaaagaaaaatagacataaggtaggcaagccatagtatctttgacaacagttattaaatattgtatgcaaattttatatattatataatacacatatatgtatttatgtatgtgtatgtagatagcatggccattctatgtgaagtgacattttctaagtagactgcaaagagttaagtatgatcattgcaaaccttagaacaatcagtgtttaaaaaattaatctctataaagagatgtagtaagaaacacaatagatgatgctacatatgttcaaataacccaaaaagatggcagggaaggggaaacagaagaatgtcaaatggatggaacaaacagaaaacaaatagcaaaatagtagaactgaacccaaatatatcaatcattatagtaaatgacaatggtctacacacactcttaaaagacagaagttgtcagaatgcataaaacaacaagcattattcatatgctgctcataagaaactcactgcaaatataatggtgcaggtatattaaaaggaaaaagatttaaaaagattatctatatgaacactaatcaaaaaagccaggttggtgatattgatatcagacaaaatggacttgaaagcaaatatatttaccagggataaagtaaaacattacataatgatagaagagtcaattcatcaagaagacataacaataccaaatgtgtatgcatctaacaaaagagcttcaaaatatatgaagcaaaaactgaagaaactgaaaggagaaatagataaatctcccatgacagttgggaacttcagcactcctttattagtaagatatagaactggcaaagagaatctgcaaagatagggaagggaacaacaccatcaaccctctgcatctaattgacgtttacagaacactctacttaataaaaacagagctcacatactttcaagtctgcatggggcattcaccaagaaagatcatggaaatcataccaagtatgttttctgatcataatggaattaaaacagaaatcaactacataaagataacagaaaaatctccaaatacttggaaattaaacgacaccttttagatgatcattgggtcaaagagaaagtcttaagggaaattagaaaatactttgaacaataaaaatacagcatgccaaaatttgtgggacgtaaataaatcagcgctttaaaaaattaaggcactaaactcttctatgacaaaagaaagattgcaagtgaataatcgtcttcaccttaagaaactacaaaaaataaagagcagaatatgcacaaagcaagcagaagaaagacgagctgaaatcagtcaaattgaaaatagtaaaacaatacaaaatattaagaaataaaagctgactccttgttaagatcaataaaattagcaaacctctagcgtggctgacaaggaaatatagaatagaagctagaactaccaatatcagaaataaaagagactttttttagtgcatcttgcaaacatcaaatggataaggaaggtatacttcaaacaactctccacatacaaattcaacaacttacatgaaatggactaaggccttgaaaaccacaaactgccaaaactcccccaagatgaactagatagcctgcatagccctattagtaaaattggatctgtagttaatctttgagaaagaaatctccagccaggagcggtggctcatgcctgtaatcccagcactttgggaggctgaggcgggcggatcatgaggtcaggagatcaagaccatcctggctaacatggtgaaaccctgtctctactaaaaatacaaaaaattagccgggcatggtggtgggtgcctgtggtcccagctactagggaggctgaggcaggagaatggcgtgaacccgggaggcggagcttgccgtgagccgagattgtgccactgcactccagcctgggtgacagagtgagactccgtctcaaaaaaaaaaaaaaaaaaagaaatctccaagccaaggtggtttactgtcaaactctaccaaatatttagaaagaaatagcaccagttatatacaatttcttgaaaaaaaggaaatgttttctaccttatttgatgagataagcattaccctgttgtctaagccaaataaagataatacacaaaaagaaaactacagactaatattgttcatgaacacatataaaaatatccttacaaaactattagtaaatttaatctggtgatgtatagtaagatgaatacaagaccatcaacttgggcttcttctaggcattccaaaccaggtcaacattcaaaaatcaatcaatataatcaactgtattaactgtctcagaagtaatatcacatgatcatatctattggtacagaaaaggcatttgataaaacttagaatccactcacaataaaaactcaaagcaacctaggaataaaagaaaaattactcatcttgctaaagggcatttacaaaaacttatagctaacattttacttaatagtgaaagatgtaatttcccccgaaaatcataaaaaaaggctagagaatccccttttacccattctattcagcattataatgaaagtcctagcctgtataatagggcaggaaaaaaataaaagcatgcagtttaagaggaaaagataaaactgttctattcatagacaacatgactgtatacagaatcccaagagtagccaaaaaatcttctagaactaaaaggcaagtttagcaaggttaaacaaggtcaacacacacacacacacagacatttccatgcattagcgattgataaactgaaaaccaaaatttttaaaaatgccattttaaataggtcgaaaagtgaaatatataagcataaatatagcaaaacatgtacagaatttgaatgctgaaatagaaacaacactgatgagagctttcaaagaagacataaatcagtgaagagcctactgtactcaagattccaacactgtgaaaatgctgactattcctaaattgatgtacagattcaaaataattccaatcaaaatcccagcatgatttttttagacaaagacaaggtgattccaaaatttatatgaaatgtcaaatgaatttgaatagataaactattttttgaaaaataaaacggggaattaaattccttgatttaagacttactcttgagctgctgtaatcaagccagtgtggtgttggcaaagggttagatccacagatacgtggaaggccatatagagtccaaaaatggacctacacaaatacagacatttgcctttgttataatggtgcaaaaacaagtcaatggaaaaagcacagattttcaacaaatggtgttggggcaattggtcccttatatgccaaaaataagaacctcagcctaagactcgtaccatattcaaaaattaactcaggatgtattatggatctacatataacatgcaaacactggaaaacctttaaaagaaatcacaggaggaaatatttgggatcagggagttgaggaaagcattattagatgtgacttaacatcaaaagcataattcatacaagaaagcaataatgtattggactttatcaaaattagagcttttgctgcaaaagacattgttaagagaatgcaaaggtgactgttatgggttgaattgtatcctcccaaaattcccatgttgaagtcctaaccccagtacctcagaatgtgaccttatttggagatagagtctttgcagaggtgatcaagttaaagtgaggtcattagggtgagtcctactctaatctgactcgtgtccttataaagaaaggaaactataacaaagacacacacagatagaagaccacaggaggacacaggaggaagacagcatctcatctacatgtgaagaagcaaggcctccggagaaaccaatcctgcagagtcaccttgatctcagacttctggtttccaaaaaaagtatgagtgtattagtccattctcacactgctgtaaagaactacctgagaccaggtaatttataaagaatagagatttaattggatcacgattccacaggctgtacagaaagcatggctggggaggtctcaggaaacttacaatcatggcagaagatgaaggggaagtaggcatgtcttcatgtggccacagaaagaggaggatggtgaagggggaggtgctacacattttttttaaaaactggaccttgtcagaactcacatcacgagaacagcaagggggaaatccacccccatgatccaatcacctcctaccagacccctcctccaacattggggatcacaattcaacatgagatttggatggaaacacagagccaaaccgtatcagtgagatagtaaattccctttgtttaagctccccagcgtgtgggacttttttagggcagccacagcaaaccaatacagcaacttgcagactgggctaaaacatttgcaaaccacatatccaacaaaatacttggatacagaatatgtttttaaaagtcttaaaacttagcagtaagaaaataaatgcaccaattaagaaataaacaaaagacttaattacacgaaaaagcttttgcacagcaaaagaaacaatcaacagagtgaacaaacaactagcagagtggaagaagatatttgcaaactatccatccaacagggactaatatccggaatttacaaacaactcagacaactcaacaacaacaacaacaaaaccccaaacaatctcattgaaaagtgggcaaaggatgtgaatagatatttttcaaagaagatatgaagacatacaaatggccaagaagcatgcggaacaatgctcaacatcactaatcatcaaagaagtgcaaatttaaaccataatgaggttccatcttaaaccagccagaatggctattattaaaaagacaaaaagatcacagatgttgatacagagaaaagggaacacttatacactggtgatgggactgtaagttagtgcaacctttatagaaagcagtatggaaatttctcaacaaaaactaccatttgatcctgcagttccactactgggtgtacacccaaagttaaagaaattgtgataccagaaagatacctgcattcatgttgaccgcagcagtattcacaatagcaaagacaaggaaccaacctaagtatccacgaagggatgtttgagtagggaaaatgtgatctctatatacaatggaatactattcggccatgaaaagaatgaaatcatatcttttagcaacagggatggaactggaggccattattttgagtgaaacagctcagaaaacagaaagacaaataccacacgttctcactgataagtgggagttaaatcatatgtacacagggacgtgaagagtggaatgaaagataacagagacccagggtggggagtgggatggagacaggacaagaaattacttagtgggtacaatgtacattattcagctgatggatatgttaaagccctcacttcaccacaatgcaatatatccatgtaacaaaattacacttgtatcccataaatttacacaaaacagaaataggcaaaagatggaaaaagacattttaccaaacgatcacaaggaagggaaatcatcacataaaaatattttccctcatttgccgttgatgaagtgcaaaataaaaccataatgagatgccgttgcacatcaattacaatggccaaaatgaaattactgagaatgccaagtgctagcaagactagaaagactggatctctcatttcctgctggtgggaatgcaacaggatgcagccactctgagacatagtttggcagcttcttcatgattaagcagacaccgtatggctgagatcctgctcccggggaaagtaaacttgtgtgcacacatgtaagaaaatttcatagcaattttattaatgatcaccccaaattggagctaatccaaatgcccttcagcaggtgaatggataaacaaactgtgatccatccatacaaaagaatgttactcagcaacaaaaggaaatgaactattgataatatgcaacaatttggatgaatttcaaaggcattatgtggaaagaaggaagtcaatctccaaactttatactctgattctgtatgaaattcaaaaagctttctgagcttgacctccttccttctgcataatgtctttgaaattcatccaaattgttcttctatcaataggagggcgtgttttagagtgatggagctgttctgaatcttaatggttacagtgttaaaattcatagaactgcacatcaaaaaagttatttgtacggtgggacgatttttaaaaaataatataaagaaccatcagactcttccagtcttgctgaggactggtggggttgtgatattgaagctgtgtgcatcagagccctacggaaggccagagaaagagtggcgtcaccgtgtggccgtgcctgaattgcccagtggtgcagagcatgaggccacagatcaggccaagccgtcctcccagagactcacttctcagcaggtgagcatcaggctgttgttgaccggctgagccaggccctcctcgcctgtcacctgaactgttcatcctgttatggcccctctgcctgactgccttcattctctctccctccaacccgtctttttccctgcagccaatgtggtttttcttaactgtgcatccagcccaccacacctcaactttaaatactccaggagcttcttttctaaagaatggttcaaactccatttgcttactgtgcaaaacacttagagcccaggctgcattcccgcagctgcctacaaacctcatcccttcacggatctgctgtgtgactctgggcaagccaccaagccatgcccactctgctggtacttgtcgccctggtatggaaaatggggtgactataacagccatatcccagagttagcatagggaggaagtcacagtgacatcgaaagggctcaccaaaggctccttgctactgtttttattcggggctaatcccataactgttgttattacaaacagatacagacatccagtgcccactccgccacggtcaccacgaacgtggaatccgggttttattctgactctaccatactattacttagaaccctttctttacaaaaaggaaattgcgtttaaattgcttaaacaacaataacaatgaaacatattggctcatgtaactgaagagtccaaagaatgatttggcttcaggcatggtttgatccagaatctctaaagacatgaccaggactcttgttttttctctccctccattggtccagcttttctttggctgccttttcaaaacatctctctctgcattggagccagatggtcaccagcagctcccaagtccactggaccagctgtggacagggacaccctctcccagtagtctgtctggacagttgcaggaaacgccctgctcaggtcacaggcccatccctgaccccagatactttctcaagaatgtggagttcttgtccacaagctgattgtccaggctgaggtcatgtggctgcctctgtggcctgatgtctgaatgggggtgaggagaggggttgggtcagcatcatctagatggcatggaacaggcaggactgggggtcttcatcatgggcccccacactgtgggctctaggggtttcattgttgagagggaagtatggaccactggacagaccagtgaccacagtgtctgtggctgtgtgtcctgggacagtttgtaaactttggtggcctcatttgtgacacgggatgacagcagtccccgcccaggtctgctggagctctgagaggataagggtacccacagcactttgcaagtgcctgtcattagtgagaactctgaaactgtgccttccacagctacattgtgttattgttttgtgtggttgctttcgtattgcctagcaaatgacctagtcatgctaagaactaaattgatattagttcccttcactttgcagtcccacggacatttcaatcaccttataactcagcgtgtttgcaaattctatcccttctgcttgggaagctcctgttccaaccacaaataacaccccatcgtttagtagtaacagcattttaaacagcatttgtgtggctcttgcagctttttatgctctcttcatgccccctcatggaagcttcgcacacactcttggttctgtcgcatggttcccttttgacatcggtggcatcagaggtccacggaggagccacaggactgcctgtcggtctagcattaccttgtgcggcttaccttgtctgttttggctcccaaggctccagagggcagggcccagggctcaaccctcacatgtctcaagagctcagtacacggcggagattcccgggaaatgctgcagtgaactggattgtgaggcaatgcacagaacacagcactgcgtggcacctagcagttatgacgtttatcatcccgggtttctaccagtgccaggagagtcctgggaaatgagagtccactgagaggtcatgggatggaaggaactcacagacttggggcacagatggcttctctgtgcctgtgtcacccccgcctgcagatcccatgtccatcctggtgcccgagagtccccatcctgcatgcatggctttgaacctgctctgggctaggaatgtcaggcagtgcgtctgagcttcagcctctccatccataaaacaggaataacattactgcctatcaggatttcatgaggattaaataaggctgaatgagaaagaggcatataaacttgatttttacatgccttggaatataaatgcttcttaaaaatttcagtgatgccttttacaattctgaaaagttagtataaaaagtttgcctgccctgcctttctcctgagactgcatgtgaaaatcaaatacaacaacgaaagaaaaaaatgaagtgaatgtatcataccagctcagccagcgtgttttgatggcttgaactgaagacataccgagatgtcacaactgatgctgagctgtgtcccccaagccaagccattctctaccttgcaaccagaaactcacaaacacaagtctgaccatctcccctctttgcttgaactcttgggtggtcccgcttggccatggtgctcaatgccatcctggcttcaggatgatgcatgccacattttctgagatctggtcccagatactgcttctaccttggaatgtttttcttctcagaagaaacaaggatactaaaagaagcaagtaaaagcattgccctatgacggctgacaagaatagacagaaggacagaaggtgcatttcattcaatcacccagagaaaactgtgctcctggagacagaggtaacacccccagcttagcacaagacacagggcagtcagtggcgaatcctgccctggtaaggtctccaggcacccgaggcctggaggtttgtaacaagaaaaggagccaagttccctgtccccaggaaggagctggactcagatgaatagtgtgagggggataaagaaaaagtgtgctctcctcccgccgagaggcttcaagagcccctgcagattcggagtgataaggagcttagaccagcaactgctgtttgatgaagttgccatctgtgggatttgctgactttgagcaggactcagggatatctctgtgttacagcctggtcaggactgtgcagacgcgctttatctgatcctcggggaaatcattttctgagtaagctaagctatgatggcttctagagactctgccagctcccccagtggaaaggtcaatgaatcttccaccaagaaaaaataatcgtgggagggactctgcacattaaacaccacttctgagttccaaagaatgttcacaaaatagcatggcaaaaatggaaagaggtgaagcaggtgaagtttggggttcctctggggagacatttctggaccgtgcaagcttttgagggttgagattgggccttctcatggcttcatcctgtgacagtgtccagcacctggtgatgatggtttcgtggtggtggtaggcactcaagctgtgtcaccaggcaccattgtttggcgaatttgccatcatccaaggtatggccatagccacctgggcccagatgctgtcttttgtctggggctcagacttgatcagacacaggtgggaagctcatgagagacaagcacataatgaaaatgtcagtgtgctggttttcaacatcacagggtggaaggaggagcctcctggccattccctactgagatgggtgttgtttagaaactgacatttgattccctgctaccatcacaccattgttgagagcactcactctttctaaagccttggtgagagcctcctcgttcccagacctgcctcaccttgctcaccctcacaccatcctccatcctctgtcgggccagcgagcctgttccgtgtgggacgcaaccccctgacgatggcggtgtcttacctcctcaccatctgcacgctcttctagctctgcactgcacctggagcgatggggccgaacatgacctattagcaagactcccccttgccccatagaaagatgagatcagcctccttgtcatgaggttagggccaggacaccacacacgtgggttgggttccacaacatggagtccaaaatgatagaaatttcacgacattgcaaactccttagtattctggctatgcagtgatgggggcagctggaattctgaccccaggcaccagcccctcagtggctctgcccaatgctggccggcctcagtttgccacaggagcccgaggcctctctgtggcaccaagaacagctgggtcactgtgcatgtggtcagaatgccacgtggtttatggcctcaatttaaatgattacaagtattaattaatggatggttggaggatggaggatggacaggactacccaatatttactgagcacctgctttgtgccaggcaccctgaagccctgatgggcactgcacttgctcctccaagcacctctctttccatctcctaagtggccgagcagccacagccattattgccccgtgccagattcagtatgcggaggatcaatgcggcagcagagcgtccatgctctgagtggcgcgggctttgggtgatggcatttccccagctgtgttccctggcagagactgtggtgatatttctggctttgttgctatgtcaacccccgatcttgttcttgcctcctgtcttgcgtcaggctggaggcagcctctcccgagctctccctgtccctggtgtgcacgggaggctgcaggctgtgagcagccatgccgatgagcctcacatcacacagtgaacttccccttgcttggatgtctgaccaccaccatgaggggcctactcttaggctccaggggcaggctgggcacccccactgagttctcacctgaggggagagacctggacattagtggggtgaagaacgcgatgagggtcctgagacagaggcctgcttgaagagtaggatagtgtctcccgcgtcacaggtgacagcaactcattgttgaatgagcagtagctgagcgagtggacagatgcatgatgacatgtaacgatctggacttgttcaacgtaggaatggggccaggaaccataacaccacggcagcacaattgcatagtacagcaatagcatctaacatgaattgggtacttactgtgtaccaggcaccattcctagcatgacgtgcaggaaggtgtccagtcctacagcagatgtaatgcaggtgtatcactgccgtggtgccgtgcaccggggacagcacacagggaagctggggtcacggagactacattgagatttacccacctcaccgtgtccaaagagggtggggaccactttctatgcggaagaactatcagcttcataaatggttccctgtcactggagcaattgggagctggtccgtggtatgggcaggaaaccatggatgtgcgcggtcaatggctacagggacggagggcaagggtgggcaggctgagtcatcaggaggtgaagtggcagcgcatgaggactgtgtggacaacagggtggaggtggaggagacccccatgcctgggggagaaggatcgtgtggggagctgctgtaacatgctcagggagcacagagggtatgcactcctgagccacgaggaaggtggttccaattctcacaaaacctccagagcaggagaggagaagcttgccaggggcagtgtggagtggggaatggggagtgccttggaagaagcctgaagaacatccctgctcaggagggagaaccacggggagtggagatgacagaggacgagaggccatggctgcagagggtcttcctcgggctgactcaggtgcatgctgggaattgcatcagggaggtctctgtgggcttcggtgacagctgtgcacgacgatgggggaacttggtggtgaacgcaggtaattacgtctggaagtttagtgtgaagacaaggaaggaaacttgattgatgcaggaaggggtcatggtttgcaaggtgctctcttgcctgcggtgccccatggttgagtggagcaccttctgtgcagggtgacagggctgggaggggacaggggaagagtgtgtggggtgaggcggcttctgggctcctgatcagtctctggggtggctgtcttcgtggatttcctttgaggtgtggggcccaagctgatcctggcctcactattggaatgagggtctcagggtgggtgtggtaccatgtaaaggtgccagcaagtcctcacaggtagggatggcctggctcctgacaggtagacccctgaggtgcaggaagcctcttctttgagaccagcaggctggtctccccaaggaggtctgaggagcagccatgtcagacccggctctgttccgagcctgcagccagagggcaggtcccacgttccaggccttcttccctcctggcccctgtcctcagtgttgctcgagccctgagtgtgccaggtgctcactcaggggggccttggagcaccggggggccatcccctccacagggaggagggagatgggcttttctcccaggaaacgtttttttttttgagatggagttttgctcttactgcctaggctggagtgcaatggtgcgatctcggctcaccgcaacctccacatcccaggttcaaatgattctcctgcctcagcctcccaagtagctggcattacaggcatgcgccatcatgcccggctaattttgtattttttttagtagagacggggtttcaccatgttggtcaggctggtcttgagttcctgacctcaggtgatccgcccgcctcggcctcccaaagtgctaggattacaggcatcagccaccacgcccggcctctcccaggaaacattttaaaatgtactttactgataccgctaatgtctgttttattttaaaatagagaaaaaaaggaagaaaccaccccctgccttgaatagttacacctgcacttgccgtccactgtgactctctgtgaggtttatttttgtgacattttcctatgaagtaagtggagaagatggcacttcctgggtaggcaggcacctggcaggacagcagggggtgcccaggtgcacagaggctgcccagggaacgcggtttcccccacaaccagctccgccttcccacagccacccctggctggagtacaagttactggggctcagttcttaggattcctacaaagcccaatttgggtcacctgacttgttaagtcaggtgaaggtgacttacctgaggggcctgcaggatgtggggtcaggctctggcactgggtgctctctgtcctcctcaaacgctctctatgctcactggccttcagggttcttgggggctcctgtttgctcttcgggcgttggcatcctccagtggactccagggaagttaaataaatgccaagaggattcacgtggcagggccctggaggtggagaggaaggagcacaggagacaccaggtgctcactgtccagcggggatgcaggcatgaacatggcagaggcaggcagcacccctcagagcgctgagctgtcgggaagcccccggccctggtcactccccacgcctgcccagagaggccgcgccagatccattaaaagtgtttcagcagcttcagaggcccccatttgtactgcccattctggagacaacagcgccctctgcagtgccctccttcagccttggggcatgtgaaggagcattggggctggcagacagcctccgtgggctgggagagaggtggacccccgggtgagaggatgcaggggattgttgtgctctgcagttttggggcaggtgtagcctgacctcaggctcttagagggaggagtccagggccaataacctgaccctgtgaagtgggggctatgtgaccctcacagagcctctgccctgtgggctccaaactgaaagctttctaggctgagtccagaagatattctctgtggtccccatgtggagctgggggctcgttgctcaccaggagagggacgctgggtgctggggctggggggccctcctgggatagcagcaggttcatatcttgctctggacaccagatactcacctgctcatcctctacaatgcacctctgcatgccaggaagcccacagcgtgcagatgagaagaccagggctgaggttggctctgtttcccaagcagatggtggaaggcagatctgaacccaagttctgtgtgattcccaaagcagaaggacagacagctgcccccctgaatggcactgatgctgccaggggacaggagcgactcctgcagccacctttcctgagcactgaggctgaatgtgggaagcaggggagggtgccaggccccaggagaccctgaaagctggcaggaaaagcaaagcagcagtgcagggaaagcctcttgggggcactgtcctggggggaaggagagcacagaaggtgggtcctgagcttctaccattccagggcttcctgaggaggccctgcttctccttaatgaatgaacatagctgctattccaatcttctggcattcctcaccatatcagttccccctctggttgctgccttcatagcctgaggagcccctcttgctaagggtaaacccaccaggaggtaacgggaagaatgggaggacttccaccaaggtcagcttgccaagtgatgctgctctagccacagggccccttggctctgacacaggacagcatgaccattgtgcagcaaggtgacactggtgagtcctgcaccagggagagcctgtcactggcagtgccagaggcttaggatctaacagttccagtgtaactgagaggtcctagagtgcgaatgagggaggttcccacactgcgcaggttggagagatgctgcgttaccgacgctgaagtggttgatgccaggggcagggccattgctattctaggatggttcaatccccaaacctcatcctaccacatctcctcctgaatggcttcttgatgtcccttgaatgtcactttgctgtggcttgtgctccatggagaagcagccagtcattgatctgttggacgtctgtgactcttcctaattgagtgtcctcgcccgagttcttaccctgccctgtagagccacagagcagtttgtttctgaggacagcgcttcccatgtgggaagagagtggattggtgcatccaggcttgttctccaggggtgtcctgtgacatgtgtctgggttattgcttgtattagtcagcttgggaggctgtaacaaagcaccacagaccgcgcagcttaaacaacagacatgcattttttcactgttttggaggctggaagtccaagatcaaggcattggcagggctggtttctcctgggacctctctctctttggcttgtagatgcaatcttttccctgtgttctcacacagtcatcattctgtatatgtctgtgtcctaatttcatcttatgggacaccagccatgttggattagggtctatccatatgattttatttaatgcactcacctctttaaagacaccctttctaaatgcagccacactaggagttagagcttccacatatggatttttcagaaggctcgatttagtccctaacacccctgccttggcatcctgtggtcattcacctcccaaacttttgcctctcctccctcctgacttccctatagccattgggatccatcctaggatggggtttgaaggcaaacatatagccctggcacagaccaatggggcgagagtcatatctcctttcttttcctgtcttttcaccatagaaaacctacctaaacttaagtatttgtttcaagatcaagatctcctgttgggatgcctgtgggaagcattgctcagaggctgttctccaaccttgtaccctaaatccctcaatagggtacaagaagcaggaagtggaggcctgggagccaggcagaagctgggaggatgcagacacatctctgaaagagggggcctgctgggttttaatctttaatttgctttattggtgggcttcaggcatctaatgagatacatgagctttctcacacaagaggataattttagttttgaccacaggagagaaaaacacatccctgggcttgagacagacagtatttttatggtattttttaatgcttttgagtattaaacttttatgggtgtttttaaaaattcaggaaggaacttccaaactctcatgcatcccgtggcctttgattgtcagaggtgcagcacgacggcgtggtagagggggtgggtgtggacgttagcagcccggattcagatccagacagacccctggctgcgactccaattccacatcagtaaaatggggtaatggggtttgtggggctctctgaggactgtgtgtcacgcccattctggagacaacagcaccctctgcagagccctccttcagccttggggcaggtgaaggagcatcagggccagcagacagcctccctggaccgggagagaggtgcacccccgggcgagaggatgcaagggactgttgtgctctgcagtttgggggcaggtgtagcctgacctcaggctcttaaagggaggagtccggggccagtgacctgaccctgtgaggtgggggctcacactgcaaaagtggcctggcttagcactgcactgaaagggctcagcagatgtccccatggattgatcattaggtcaatggatgtaaaacatttctgctcaaatcaaaccactaaaacggcttgattttttttcactcaacaacagctgtttcagctccagctgtggctgaaaggggccaaggtacatctcaggccattgcttcagagggtgcaagccccaagccttggcagcttagacatggtattcagcctgcaggtacacagaagtcaagaattgaggttggagaacctccacctagatttctgaggatgtacagaaatgcctggatgtccaggcagaaaattgctgcaggaacagtgccctcatggagaaccgctgctagggtggtacataagggaaatgtggagttggagcccccacatagagtccccactgtggcattgcctagtggagctgtgagaagagggccaccgtactccagaccaaagaacggtagatccactgacagcttgcaccacgcacctggaaaagccacagacactcaatgccagccatgaaagcaatgatggtgatgaaatgagagagctgctctcacagaagcaggaaaaccatggcagagcgaagggactgggaacacagatgccaggagacagggacaagtctttccagacaaggggcacctgcatttcactctcacactcctttaatgaacaaagcgaattcctcccataagggaagcatgcgctgacccctgccctttgagaggcggggaggctgggaaaggcaacaagacaccagagagcaaaagcagtgcagcacgggggtgcacagccagccaggcactggagctgggcagggccgggtggagaagacctgcagttggttgagaaatcaggagtgtctcagtggagtgactagtgtgtggagcctacctggcatatttaggagctgaacttcaccactggggcagggactggctgggtgaataaaggccaggggagaccccagggtaagatggggaggctggtacaaccctaaagggtcccctgggctgagttaggtggtccagaccaggtacttgagtcaccaggagctgcagagctctctaaagaggtcatggtacctttgggaagatgacttcaggaccaaagcagtccaccaaacagagcagtcatgtcctctgcccctaaaaatgccataaaaatgacagaaaaaggtagaataagtgtataaccagcaagagataccatgaaagagacaaagaggctgcaggatttctcaggaggaggggtaggatcagacgggtggagaaaccaaagcgaaccacacacaaaaaacagcaggaaaagctactgcaaagatgaggccaaaccctgtgcccaacaggcaggcagagacggggcatgggcgcagtcctcagggcaactgaacaagtgggcacaggaagaactggcttctgaacaaaaggaagggccggaggctgcacggcgctgcagcagagtctgtgtattctggagtctgcctccatgggcctgaatttgttctataaaacggagatcgtgaggatgtcacttttcagcttcagccagtgcagtttttatcatgatgtcgtgatgcacactgcgtgggggaggggcagggggctactggtaacccaagagtgaagctgaacaggaaggcggagcagaaccagctgcagtgttctagtgttcaagagaacagtagggaaattatagttgacgataatttattgtctatttcaaaatagccagaagaaaagaattgtgctgctcccaacacaaagaaaagatgaatgtttgaggaggtggatatcccagttaccatgactggatcgttacacactgtatatgtgtatcaaaatatcatatggcctcagaatatgtacagctatgatatatcaattagaaatacaaaacaagagaatggaatggaaggagacatggaagggaggggccctctgctgtcttcaagaaagctgccaacctgggggtattcaggataaattcacaggttacaacctgagaagtaaaaagaaaaagaaaaaaaacataaggaataaaaattatcagagttcttggaaatttttaaaatacctgagatatgtctgagtagcagaatggccaaacactgaatcattcgtctagatgcctgggttgtggagttttaccagaagagagtgagacagaggaggaaagagattagaagaaaggaaatgctcacagatggaaagaagaatgtttccccgaattgaggaaagtcgtgcatttttagattaaaaagagtctattttgggacaaaagagattaagaaaaaaatgcaagcacttagatacattctaaataaagaacttcaaaagttaagaaactatccccaaatcttttatagcgtgacaccaccaaaaagagattcctagtatggaacaagcttcttactggtgacaaatttctaatagccacatcacaccttcagagaaaatgacttccaagatctgaaaatattttgagtctgtaattctatgcccagacaaactattattcaaatcgaggagcaaaataaccaattttcatgcataaaaaacctcagaaaatcaatttacagtctatgggctcttttgaaaaataacttgaatatacatctaaacaaaacagtagtaaacaaacaaaaatcatgagcccaataagaataaggaccatgggatgaagaagaatgacaagaaaagaaacagcagaatgttgtagttaattgtaaattgatttctaggtaaaatatataaaactaggaacatatttttatactaaaaagtaggatcttaacatggcagtggtgagaattgggcaggaaaggagcgaggagaaagtgaaagtatgctaaatgtctaattttctccagtagaaggaaaactatttattatgacttttagaaaaatgttaggctgaatatatgtgctaaaaaaatacgatggtttctgaccagctattgatcaattggatgtctacatcaaaaaaaaaaaaaaaaaaaaaaaaaaaaaaaaaaaaaggattttaagaactactttgtaccatactcaaaaaacaatttgttagacttgggatctaaatttcaaagttaaaaatatatatcttttagaattagcatggtaaaatatcttcataaactttgagtagacagagttaagggtaatcattacgatcatatatagagaatttaaagaggcacatttaaaacaaaatgatataaacagaagatatttcaatggaaaaatatatccaggaaaatatatgcatatgttttaaaatataaagcaggtgtgttaatattaatgtcacacaaggaagacttcaaggcaaagatcataaaacaccagtttagcagtaatgttttatttctttcattaaaaatagaaagttgaaaagtatcataagcattcaactcagtcagttagcagaacaaacattagtctgaacacacacatacgcacacaccccaaaacaaacagaacaaaatttagaaaaatggaagttgtgaaattaaaagcagaaattaataaaatatgaaaaataacagagaaagcccagaaagctaaaagaagcttatttgaaataattgatgaaatagatatcactctgtggaaagccgtgaatccaaatggggagagataacaaatacaacctgtaagaatgaaccctctcataggtactgtggactttcaaaatagaagagaatactgccttagagtctattttgtgcctatggatttaatatctatgatgaaatggaaattttatagaaaactataaaataccaaaatttactagaggaaaaacaaaatttcaggatagacctgtaactattttataaattgtagcattactcaaaaatcttttaattccctttctccccagcaccaaacaccaacaaggcaccgcaaaggggattttgagggtaaatttctcaaaaccctaaagggacaaataattccttttcaacacagagggaaataatatcagaaagcttttcaggcctttctagaagatgatgtccttgacaccaaaactggacaaggataatacaaaaaataaaatgctacattgatttctgttgtgaaagttgatgcaaacatggtaaaaatataataaattgaattcaggactatgtaaaatttatatacatgtgtatgaatatatataattatatatatgaatatataattatatatattagtatttattccaagtttattttatgcaatgagtttataacattaggaaaaatccattaatataattgatcatattaagaaattaagaagaaaaaatacttatcatcacaattgacaaaagaagcatttaataaaagatgtaactccatagtatttaaagtgactaattcaaccaaccaatgcataatatcaatatcttaatattttagcagattgggaatatgacataaggaccctgaatacaaaaaagtgtttgtaaccacccagatatcatgtcaatggtgaaactccaggtcagttgttttcaaaggcagaggcaagataaaagattttctctcaacactctcttgaagaaagagggtagggtggatggtttatgaatcccagagaggaggaaaccaatttgctattatttgcagattatatgaatgtttatatagagtaggtttacatagaaaaggaaagttcactgagatttctaggtacaagatctagcaacatgcacaaaccaatattgtttatgtataacagcttcaaacaattagaaattgtagtaaccattatgaaagtgatgaaaattgtattgcttagtattctaccaaaattattaagtaattttttttttttttttgagacggagtcttgcactgtcgcccaggctggagtgcagtggcgccatctcagctcactgcaagctctacctcccgggttcacgccattctcctgcctcagcctccagagtagctgggactacaggtgcccaccaccacgcccggctaattttttgtatttttagtagagacagggtttcaccgtgttagccaggatggtcttgatctcctgatcttgtgatccgcccgcctcgacctcccaaagtgctgggattacaggcgtgagccaccgcgcccagccttaagtaatttttaaagaaaataatgaacttccattgagaaacttagaggagaacttaaagaaattacagacatacactctgttttcccaatgttttaacgatgagaattctccccaagtggaaatatcaactcaattatatgtggttgagagatatgctgtacatacaccgtaggattctatagtgtatatggaataggatgtgttctcatttatttttatggctgcgagtagtccatggcatagtataaatacgatggtgtatattctatatacatcatggaatactctgcagccataaaaaggaatgagatcatgtcctttgcagggatatggatggagctggaggccattatccttagcaaactaatgcaagaacagaaaaccaaatgccaaatgttttcacttataagtggtagctaaataatgagaatacatggacacaaacaggggaacaacagacactgggccctacttgtggatggagggtcgggggagggagaggagcacaaaaataactattgggtgctaggcttactacctggatgacgaaagaatctgtacaacaaaccccatgacaggagttcacccatataacaaacctgcacatgtacccctgaacctaaaatacaagttaaagaataaaaaccaaaaaaacaaaattgtaacagaatttttcacatcagaggacaagttgattctagtatctgaacagactaaatgactagaaaaagccaggtcaaaattaaaaaaataagcataaaaaggaaggagatttgtcctactaaaataaatatttccttacaagtttcaggaaataaacagcatggtatcattgctggtgtggacaacggatccactgatgccgtcatcaaagacgcatcaaacacgcaaagcaacaccacacaccagaggcctgctattagcaactggctttccctatagaacaaaaagaaattattctggcaggaaaagctgctctgaaatgccatgaagtgataaatagccgttatttatcctgcgtgttggggccactgatgtgttttgctgcaggtgcattagatgcggacggaggggagtttgcctgatgcagttgaggaccttgcggggcgattgcacctgtttccttttgcagaagactgactctgagatgcatctggtccaggtgttcaggtgggaggttgtggatggatgtgcacgagggccttaggtgccaggagaatgaatgctgatgcttgcagttgtgcatcttgagaaggggccgtggccagctcacttttcgtgtttctgttctgaaaaaccagccttgagaaaatactttgcctctatgacatcagaccactgccgcagagcttggggattcttgaagcagagatgcaaaatatgtttcaaaatatccagagagggacctgctggagtgccctgctgctctggatggtgtcctttccgcaggctgagatctgtggcctgaagcaccttgtcctgagagaggagtggctcctctggctcccccggttctgtggcttaagtctgcggggtcccaagcgggtgcccatctcggagaggtcggcattgcatctttgcagatggaaggaagccccctggagtggcaagtcgggccgagcatctgggtggatgctttctctagggctctgggattggaaatggacccgtccaatgtcggtgctgtgtccccttgcccatctccccatcagcacctgtgttgtgcctgcctggctcccacctcctgctcccagtccacacctttcccttcctccctcccttcacaccttggctgttcccaaggctttcccacttgctccttccttatggtgaaattcacagttgtcatccttgctcagagttcctcagagccactagcccaggtccagtcactggtttcagccacctttgcagaaatcaggagacatgtctcactaacaactccgagaaagtcgaactcgtctgggcgtggtggctcacgcctgtaatcccagcactttgggaggccaaggcaggcggatcacctgaggtcgggagttcaagaccagcctggtcaacatggagaaaccccgtctctactaaaaatacaaaattagctgggtgtggtggcgcatgcctgtaatctcagctactcaggaggctgaggcaggagaattgcttgaacccgggaggcggaggttgtggtgagccaagattgtgccattgtactccagcctgggccacaagagcaaaactctgtctcaaaaaaaaaaagaaaagaaagaaaaaaaattgaactctcaatccctagatgtaaaatcaacctcgtgttcttgatttcaccagtaattcataaccacaactgttgtgtcttgaacacttactatgcttggcatacttataatttttatttcactttatcctcaaatttaagatgaagtttctcctactgactccattaaatgcatgccaggatcaaggattctagagctgtagggacttgtccaagtcacacgttgtggacagcaaagccagtgtgtgagtcagagcctgagcctggaagccagaaactctaggctgaggagtctctctgtcacccgtgcctgcccaggtggcaggatcctgcttgtgacctctcaccctgagctgcagaccttctgtttcgtgatccgcgtgcctggactatcactgccggtcatcacggcaggtgttccatgctgcccatgcctggccggcctcagtccctgccggggaggtcactgagtgtccattgcatcctgggggtacatggactccctgccatggtctttctcgtctgcctgttcttgagtcttctgagcttgtaggtggggggcgtgtggagtagagctgcaacagcagcctttgtagaatgctcactgcacaccaggcatggttctgggaggcccatttccatccatttgatgagtttgtttctgcaatagtgccaagcacagtagaaggcaaatactcagtggctcatgaagacatctagaagtatttctgttgcttccaaacacaaagtatcctctgagctatgcacagtggtgggtggtgccattcacggaccctgtgttctctctgagcagagcttcctctgtggaggaggtgataatggggtcacataaattccttcacaggtgacaagagccagcaaggctctccatgtgaagcccgtgaggacacgggatccctgaggccaaggccaagtctgatgtccctgaggccgggccgatggtgggcatgtgtgctgaataaataaagagtgctgctaagtgctaagatgagggcatgagaagggcttccccttagctagagtctgagggccagtgaggactcacaggtgacccctcctggcgatcaggccttgtgtcccatgccgctctcttccatagggtgacagcttcaacagcgtctccattccccctgggcctgtctcctgtgagcctcctggctcacagctcctggttggctccctaccccctcccaggcagcacagtccagctgtggacagtccagtacagtccagcgtcaccacatggacactgagggtggtgtccctggacccaatgtctgggcagtgataggatgcagaccacaccaagagaagcccggggtcccaccagctgaggggtggttaatgggggtccactccacagctgcagcctggagacccccacttgccagcctggtgctgtcagcagttctgggacaggtccactgtggatagacagggaaggagagagggctcaggtgccctctgcagagcattcagggtaagcgaggtcttgagggactggccaactttggagatgggataacgagggatggacgcttctcccagcaggggagcatggccgccatggccccttctttgctggaagggcctgatttactttggatttcacccttctgtgcatccaggaagggccgcgcccagtcttgggaactgaggggtcagagcagttatgcccagtgttcatggggacacagggcatggtcccacgtgggcaactgcaggcagaggctgatggtgtaatggcgtgtgtgggaggatgcacctctctctgtgttggggctcacatgtttccttggactccagcactgctgaggccacccggggaccatccagaaagatgaatagacactctcaggcccttgatggctctgttgtgtggcccaggtaacccatcctccctctgggctttcctccagtttggctgaggtgggggtggggctggacagaggggagctgctgggacttggggccatcagtgccaggccaaggggagcagcctcatgaagaaagcaccagaaagcaggagttgggcacataggcagcgtgtcccacctgcaggagaggcctagagaggtggtcagagctgggggccagcttgccgcactgacccaaggctcagctatcaggaatcaggagggaagcagtcctttccactcactggccacactttctgtaattccagctgtgaatggttggggcctgggcttagtctaggccaccaggaagaatatgacgtggtacctgagggcctgcctgcaggatgccttttggttcacgagaaaaaatgatggggtctaagccaatgagagcatgtacctatgtgttgtgagttgatgttccagccacagagctaggaaggagttggattaagtccctggagcaggaatggcttcctagaggaggccagtatagcagtgggagaacccagtggtacattttctcattgttaagggtgaagggtacatcggaggagagacctctccataaaaatatccatgcagcaaaaagtggtccaaagcacctgctctctgtttaggcaagcatacctgaaagaggtggcacagtcctctcagggcagtggagggatgggggctcccccagcaagaggatctggcaagatacacagctctggtgacccatgggcagctgctagggagccttctctccaccctgaaaatagcttctggctgctgggtgaactatggagagaaagcgttttattatttttcctagccctgtaatgcattgcttcactgtcagcttagcagggagaggagagcagccaggatcacattgacctcagctcccaggatgcaggatactaaatcaatcaaactagattaaaagctttggacatatcttgaactcagggttgggaggcaaccctttcttcttattccagctgcttcccgggaggatgcccagcatgcggggatctgcaagggctcagtgctttgaattatttaaagatggagcagggctgggatatgggaaagtatcctgacttagagctgcagtgcgttctgccacagagagccatggggatgccctgctgatggtgaagacaaagtgcaggcggaagacaaagtccaggcagacttggttgtcaccatagtggatttcccagtttaagagactctattctgcagccaaggggctgctgccttttgtatccacccctcctccccaaaccaagaccaagaaatactccttctacctggtctttgaggcagccctgcccctttagaggagacggaagattggtcagaagctgtgggttcaaatcccagccccactcctgaagctgggcaacaccgggaagctgattgaactctctgggatctccctccactgtgaatgatgttcattcttaccagctttatgggtccaagtcattccaggcactatcctgggctttatcctcccacttgtgaataaagcacattcattgagcgcctgctatcttacaggtttacatcaggaaaacaaaacagatgacatccatgggctctcaaggaaattgcaatataatgacaaatttctctcaactgtttggcttctctggaggaaatacgcaggatatgcagtaagaagtgagatgggatcgtcaggtaaggctgcctggaggaggtggcatggaagccaaggctgtagagcaagttgactaggcattgcacagggggaactgcatccttggtagagggaaaggaatgtgtaagccttgaggtaggcaccagctctctggttagaggaagagacggtaggccctctccagggcagcttgagcttagggaaggaagataagtatcatgacaagaggacggatgggcctagatctcacaggatttgtgggtcaggcttggattggcttattctagggctaatgcaaagccagggctgaggtttccggtggtgatgacctgcactgtgatgggaccttttggctgcttctggtgcaggcaattgtcagccttcacctttgccccatcagctttgccagaagtttggccaacttccctgaaaggccttttctaaccatctcagttaaattgcagtctgcatttcataatcataaagaggtcaattatctaagaagacagagcaatacttaatgtgcatgcacctaacaacaaagcatcataacacgtgaggccaaaaacgatagacccgtgaagagatgcatccactactgtagtaggagacttaaaatccctcagtcagcacaggacagatgtagcaggcagaaaatcagtaaggatgtggttgaactcaatggtaccatcaatcaagtggatataatcaataccaatagatgacttcatttaacaataacagagtacatatccttctcaagatcacatggaacattcaccaaaatggatgaaagtctcggccataaaacacatttaacacatttaaaagaatagaaatcatacagtgtgtgcctttaggccacagtgcaattaaactggaaatcaataacagaaagctggaaaattccaaagtacttgcagattaaacaacacacttgtaaataacacatgggtcaaagaagaaatctcaagaggaattttaaacatatttggaactgaataaaaatgaaaagataacatcacaatttgtgagatgcagcaaaagaaatatttagaggaaaatttatagctttgaatgtatacattagaaaagatgaaaaatctaaaatcaatcaccttagatgtatatattagattggatgtaatttccaaagcataggaaaataaataaaaattggaacaaaaataaataaaattgaaaatcagaaatggacaaaaccaaaagctggcttttgaaaagatcaacaaaattgataagcctctagccaagctaactaaaaaaagagagaacacaaattactttaatgagaaatgaaagagggaacatcactaccgatcttatgaacattaacaggatagtaaaggaaactatgaacaactgtatgcctccaaatttaataacatagattaaatggaccaattccttaaaagacacaatctggcaaaattcacgcaagaagaaatagacaatctgaaagccatctatctatcaacaaaattgaatcaataattaataaccttcaaaaagagaaagcactaggcccagatgggtttattggtgaaatctaccaaatatttaaggaaaacattacaccaaatatctacaattccttacagagaatagaagcagagggaattcttcctctcattctattaggtcagtcttaccttaatacccaaaccagacaaagatattttttaaaaaaagacaacagaccaatatctctcatgagtatagattcaaaactcctcaatcaaatattagcaaattgagtcatgaatagaaaaatacataaaaataattatatattgtgaccaaataagacttatattaggtatgcaaggctggttgaacatttgaaaatcaattaatataatcaatcataatggtaggccaaagaaggaaaatcaagtgatcacatgaaaaattgcagaagtacttgatattgtaaaactcaacacccattcattataaaaactcctagcaaacttagggcagagagtaatttcctcaaatggataaagaacatctgcaacatacctacagctaatatgatatttcataggtgagaaactggaagattttctgctaagacaagaaacaaggaaaagatgttccctcaccactgctttcaacattataccagaatttctagctattgtgataagacaataaaataaaataaaacgtatatggattggaaaggaagaaataaaactgtctttattcacaattgacataaacatctatgtagaaatccaaaagaatgcactgaaatacaaaccctgaaattaataagcaattatagcaaggttgttggttatacagttaatataaaatgtttgcgacttttctatttatcagcaaagaacaaatggaatatgaaataaaaacaaaacaccatttacattagccttccccaaatgaattacttatacatacatcaaacgaaatatgtacaaaatgtacatgagaaaaattataaaactgtgataaaataaagaaataactacatggggaactattcaatgtttattattaggaagacttgatattatcaagacatcagttcttctcaactcgatcttctcaatgcaatctcaatcaaaataccagcagcttattttgtaggtatcagcaaagtgattctcaggtttatttggagaggcaaaatacccagaggagccagctcaatattgaaaaagaacagagttggaggattgactctacccgacttcaagacttactattaagcatagtaatcaagacagtatggtactggtgaaagaacaggcaaataaaccaacagaacagggtagaaagcccagaaaaagacccaaataaatatagtcaactgatctttaagaaaggattaagggcaatacagtggacccaaaatagccttttcaacaaatggctctacaacacttggacatccacatgtaacaaaatgaatttagacacagactttacacccagcctaaaaattaactcaacatgtattatacatttacatttaggctaatatgatactaaatgttgagaaactataagtgtaaatataaaatgtaaaatgaaaatctagaaaaatcccagaagataagagaaaatccagatgaccttgggtgtggtgatgactttttagacacaacagaaaaaacatgatccatgaaaaaagtaattgatacgttggacttcattaaaattaaaaactctctctatgccctcttccttggtggactcaccctgagcttctgtcttagtccctggctcctggttgggccccatggccctgcctgagtccttgtgctgtgggaggctgcactctgccagggtgggggccgcacacccctctggctggcccctgcttctcatcctccccatccctggccaactgtagcttctggagacagcatggctgcctgcgcagtcatcagctacacagatcctcagctgaacactaggacttcacgcggcagtccagcttttccctactgctggctctctcctgattggcaatgcccgactgctggaccggaggtgctgggtcccaggcatgagttaaaccatgtgccctttgggttcctcagactgttccaggcaggggcatgggccttaccctcctccctgtctcccaagtctcctgcccccttgcctggcacacacaatgccaccctttcctgcccctgccctgccttgtctgcaccttctctgggttgcagcagcagagagacctgtgcacctgcccctccaggtatggggcctcccagctcaacatgtagccctttccttggaaacccaactaactggtgagtgcacgtcctcaactccccaggcaccctccctctggcctgcagacacaattgttcttgccacatcagatcccagcgggctccttggtgctcagtgctgcggctgccacggggctgtgcatgccctgcctggccctcctcttaggaagacaaagagaactgcaggcttgggagagccttttacatgactcggtgggttcttcctgtttcccttcacaactaaagccataggattgaatgtttctcaagaaaagagcgtaaatcagggtgtacaattgctgaattgcctgtttccaagtggaagggatagagccgtgggtgctaagagacgagaactttatcctagtcttacctccctggagtgacctcggcaagggaattagctcctaactgtggtttcctgagggtggaagcacagcgtggctcgttgttgctaagtgcttttcctgtggtaacgagtgtggtcattgtgatttattggcgtggctgagtgttggctctgactttgtcttccctgtgctagtcatctggggacagaggcccgtttggccactggggggtctttgtggagacggcccaccagcatcccgggacagaggctgctctggcccccctgaacgcgtgtttcccacgctgtcctgcaggtgggtaggtctgcggcttccacgcgctcccaagctccagcatggtctctggcacagagcagggccctgaagctttgggatcgttcagctattccatcctaatcctagaggcagcatgtcctggaggaaataaatcaggctcaggacaagagcctctgagctcaaagtcctgccctaccatttccaagcctctaccttgatcctgtttaatttaatttaatttaattaattaacttatttatttatttatttattttgtgacagagtctgactctgttgcccaggctggagtgcagtggtgtgatcttggctcactgcagcctctgcctcctgggctcaagcgatcctcccacctcagcctcgtgagtagctggcagtacgggtgcacaccaccacgcctggctttttgtatttttagtagagacagggtttcgccatgttggccaggctggtcttgaattcctgtcctcaagtgatccacccgcctcggcctcccaaagtgatgagatcacaggcatgagccactgtgcctgaccctcctttagttatgttttttaatgtataaaatcaggatgatcataattctgggtagagttgtaaccacacccaagtttggccactcaccactcaaaagccaaacatgggagactgggttgtgggaggaaaagcagttttgtttggaaagccagcaaacctgagaagatggtgaactagtattctagagaaacatcttcaattgttcaggctggctggaggatttttctggaagggagatgtggggaagaagagaggggtggtatcaagaggtgaccaaggaccacagagatctggtgccagcgaggggccgaggaggatgggaacttctttgtccttgcgtcaagatgcttctgtgaatcttaaacaaaacatagttagttgtttatagactttccctttacttagttttgaaaactacacgattgtggtttttgcattattatctcagtgctctaaaattatcctatcctatcctacgtgcaaaaatgagtaaagaccccttcaacaaaaattgagtgagtgctgtgagttcttttgctgtttcactgttgcagaatgactggatattacagatgtttgcaaaatgccttgaacatattagaagttccctaaaaagccgtccttattattgttgtttgtttggcactttctggctgagttttatttcaacaaatttctaatggcaaactatttttatgttcaaacactgaaagcacaatgtaacaaaacggcgatgttctatagactttggtgtgtacgtgcagcgactggagacaatagatatattttcttgcttttaaaaggagttgtgtgctttaattaagaaaaagagaaagttttctcttagcatattaattatctcgcttgtcatatcaggtatttgttccggatgacaggtcataattagtgcacagaacagactgaaactcccaacgagaagacaggtgtcttggggagctgggactgatggcgttctctggcgtttcaccaggcgcgggaagggcatgcctggaagcagggtctctttggggtcagatgtagggaagaaaaagcaattcatcactgcctctctgagggcccctaagatactgtgccttttccttaaccctccctgggacagttactctttcacacagctttgaggccatgcaacagataagaacggtagaaaaagtcagcactttggttccattcccagatctgccaatgacgatgccagtgaccttgggcaagttactcaggagctctgtgtctctcctgccacagtgcggtggattgaccgggatgggggcacagggtgccaggcacagtgtcggctgcacggtaggaacttcataatcataagcccagctttcttccccacttaccacattcaatcagagttagctattttattaattcacccacacaaagattcagaagtcccacactggatgccttttctgtgctgggcatcagggcagagccgtgaatgtaacctaccccctgccctggagagatctgtgtgcggacagacattggaggagtagggaaaatgctctggcccactgagctccgtcattttcctcctggcaggtattttccatgctgtctcatagatggatggggctgagcatctgacttgtggccaagagccatgagcaacggtggggttcaccgcttccagacctgcctcctacaaggcctttttatctccctgccccttttctttctccatttgccagctggatgcagagggcaaagtggagttccctgaggcccagggaggatgtgaagccaccagaacaaagaggcctgagtccctgagtgaccatgtggagcagagcactctcccagttcttgcccgctgtattagcttgttctcgcattctatagaggaatactcaaggctgggtaatttataaagaaaagaggtttaattggctcacagttctgcaggctgtacaggcatggctccagcatctgcccctggtagggcctttggaagcttccaatcatggtggaagatgaagggggagccagtgcatcacatggaaacagctgaagcaaaagagagggtggaggaggtcccagactcttttaaacaaccagatctcatgtgaactaactgagcaaggactcatcaccaagggttggtactaagccattcataagagatccacccccatgattcaggccctacctctaatactgggaatcacatttcaatgtgagatttggaggggacaaatatccaaaccatatccctagcttaggtgactggttgttgcatggagccgctgagatatgggagttgtgtattgcagccattacatgctctggtgggggccagccagtggggtgcctgggtgggcctggaagtgagatgccagcccctcctcctggtgcaagagcggctgagaaaagccctcatccttgcctccagtcgacatgcacagtgccatgtggtgagggcccagtgatgggatgaaggaaggagccagggagagcccattccccgagaaggctgggccttcctctttgctgttgtggacgctcgcatcagaaacccatacagtctttgagagtgggacactccatcttcttggtgcctgtgtcccctggattagcacaggcctgtcccaggtaggccctccatgtgctagagttgagcacagcagcttctggaaggtgggaaagaaactggtagagaccaaaatggtacaaaagttccttctttcccacacacaggactcactcccagcacctgagaagggaagtgggcgattacctgagtgagatgttcccatctcaacactgtcatcatttaaagactgttgtttgatcttatcatcacaactggtacattacagcacttataggcacttacattagacaaatgttaaatacattatcgagtttaaaatgttattatggtaatagggtgcctgatttcactgcagttcatctgaaaaggtttcagtgcttgagaatatttctatttcaaggttaattaatagataatcatgctgatttgcctcagagggatctccttcgcacacccgggccactgtgagtgtcaatttttattatctgtaaaccttgttgccgacacacccttcccctgggtcctcctgccccaacacattcaagcaaagcgactcagtgctcacaaggagttttgacaagacatgggttccaacacattttattctgttcacaatgtagaaaaaccactgcttcagaacacatgttttaaatattaaagtgctgaaggatacattcaaaaagtacaagaacacataacataatcatctcctcaaggtaatattagcactcaacggccaaaaattgcagcaaagagaaatggttgcatccttggagctacgtcatcctggttgcccaaggtctgttagagcaaaggtccctttctctgcagggcaggtctttcttctgaatcacagaatgttggttctgccattttgaccaatagattagtaaccagttaaacccagactgaaacaatgagctgctagagtttaatttttcctggtaggaattcaatgtagggcactcatcggagaaaaagtcaattaccctctggcatccgctgcttggttacagcagtcactgcctatccatggactaattcaaccagtaaaacatttaatgaccatctacttaaggcagatgcttgcacaaagatcaatcagacccagacccagacccaaacccagagctccatgcctggagccatcggaacctgcacaaagacggtgcggcttttggagggaatctcttctaatccccaaattgatgacctctggaagaatgtgagggaactccgcgatctctgctctgtaagaacatgggcctctgtgccttggttcctggctggtgcctgcctcagacttgctgcctgggttcccccgtgtccccactgctgcctctgcatctcactggcatttctcaagggcccaccctggcccaggcctcttctaggagctttccacgcactctctgattcctcctccccacagagtgctgctgggtgctgagtggatggatggaggttgctgtcacgaggaagtgaagcagcatatggaggaaatttgcagtaccgcacccctcctaggcatccccaggcctgtaacatcactttcctcctctcctctcttcctctccgcacccctcctaggtatccccaggcccataacatcactctcctcctctcctctcttcctctccgcacccctcctagacgtctccaggcccgtaacatcactctcctcctctcctctcttcctctccgcacccctcctaggtgtccccaggcccgtaacatccctctcctctcttcctctccgcaagcacactttacagcttcctttgcagaatgtcgggggagtcaattttagctgtgaggtgttgaaaggccttcctgaaagaggttgttggaggaggagaaggaggaggaggaagagggagacacctgaaaaggaaggggaggaggaggaggaggaggaggagagttggagcaccccaaaggatgggggtggggggcatttgcatggtagggatactccagaatcagcatgtgcaaaggctctcgagggggtgggggtaggtggagtggttcaggcaggaacattctggagtccttggtagatgggcatactgtggttgagggagtaggttggctggatgggtctctgcacagaatatgtagagcagctgcctgattctttgaggtttattattccgaggggcaaagaagcaattgcgtctctcttaccatgcgctgcctttgaacattgctgctgctttagcataacattagattaaatgtgctctttgtctgtctttaaaataaactccctgaaggattaggttgtgattttgttcccaagttaactctcatttatctgaaatcctgtctgtggtagctcagaaatctgggtccattccttcactgacatttcctgtttgtcagcctggcctagcgtaggggaagagttgttaatgcccatccatcccatccagtggccgtcagaataccagagcagggcttacgagcctgtgtcagggcctctgaaggatttagacacaccttgggctgtggcctggagcagtcaaagtgcagggcgggagccctccccacaatccttgcgttctctcaccccctaaatctgtgcccattggaggctggacacagtcctggtgcaggaggcacagtggtgaagatcagcaagccagtgaggtgcctgggtgggcctggaaattagatgccagcccctcttcctggtgcaagaggggctgaaaaaagcccccatccctgcatccggccagcctccaagagccacatcgcctgagctgtgcagcattgacatctttccagagttaacacagataccctgcccagtggggcgtgtgtgagaaacaacgttgagggaatgcacaccctggagcaagggacaggggtcactggaaaggcccctccacacattgcttccaccgcaggggcctccttgcgggcagaggctgcacgggatgcatctttgtccccagatcccacagataaggacgttggtgtctgccctaatggagagttttgctgctctgtgagaggcacacagagcttcaggccctgctcaggcttggtactggctgcggaagcagggggttcaggctgcaggattctcctgagcggcagatgtcctcgtgctttgctttctctcttagccactggggtcacaatgcaatgtaatcagtggtccacactgaccaacaacagggcttcctctgagcagctcctggacagagcaggtccttggtactggtctgaggctctgggtctgatggtcagatctacccccgtattgcaatctgggacacatatttccccaggaagctgtcgggagtgcagaccagcctgatgctgagggtgcagccctgaggttgctggggtctgctttagcccccgatcccatgacctgcacctctgccctgcccactgtccggctgcctctcagcttccaagggaggcctctgggaaccacccaggcttcctgtacggtactttcctttggagcctggatcagtcaggctgagcctggctgtgctgtagaaacaaacaaaccccactttaaagatttctcactcagttaagtccactgcgggtctgcagctccccaggcagctcccttccacttggtgactcagggatccaggaggcctctctgaggatcctcatcttgctgggagagaactctggacactcacctttctccactgccaccggcaactgggaagtctttccatgaagcccaggaaggagcgtaaaattggatgagatactgtagcaatctccatgcaacatccaagctcttccaggagagaaggacaggctgagaggctgggcagacccggactctattcctgccccagcaccctcaggagtgtgtgccgctgggtgggtccccttctgtgcagagcagcaattctcctgagccaaaaagatgtcaggatcaaagttcagctgttcctgaacttgccagcccctgctcacaaaggctgcagagccagaacagagacgaagaagctcctgatgcctgtgcctctgtttaggtggtgtgtgtgtggggtgtatgtgtgtggtgtgtacgtatgtgtgtgtggtgtgtgtgtggtttaggtggtgtgtttgggggggagtgtgtgtgtgtggtgtgtatgtatgtgtgtgctgtggtgtgtggtttaggtggtgtgtggggtgtgtgtgtgtgtggtgtgtacgtgtgtgtggggtgtgtgtgtggtgtgtatgtgtgtttatgtgtgtgtggtgtggtgtgtgtggtttaggtggtgcacgtgtgtgtgtgaggtgtgtgtgtggtgtgtgtgtgttgtgtgtgtgtggtgtgtatgtgtgtggtgtgtgtgtgtgtggtgtgtatgtatgtgtgtgtgtgtggtgtgtgtgtggtgtgtatgtatgtgtgtggtgtgttgtgtgtttatatgcctgtgttaaggttaccggaagtaatgcagcatatctctttagtttcaaattctagataaataacaaatactggttttctagtgtgtgctatggaatatttgaatgcatttatactaaaaatatgaggattgtttatgctgtacttttacttgctaactctgacaagtcgtgtgtgtgtacctgtgcacaacatttcagctaatcttcaaaacaactcgataaagtaggtactattgttctacccattttatagatgacgaaactaaggcacccagagatgaactcacccgggaccaacagcctagatctggtggagccagaaggcccctcacacagcctggccgcagaggctgagccctcagtgggcgccgggaccttctggcagaggctgagagtgttggggaatttcagatccatcctggagggagcctgactgggctttagtggggtggctgccggttggggttctgaagggacgggggacccttgctccacagccaggggcttctgttccacggggcttttccaaagcctccttggccctcctgcttcccttttccctcctccactccccacggtgtggccaagcgggtgaggaagctgagccacaggaattcagactttcccacggtgcccccttaggcggttcctgagtccggggtcccatctgtaaaaccctagcattccctctcctgggagggctcctttcgagaactgaatgctgtcataattgtgtttgtgcagccccgtacagaagcccagattttggcctctccatggcccacacacccccttttgccctaggagtgggccgcggtgacacctgccggctctcccttcacagaccctgccccatccatcctcagtcccatctaccccggccccagaggggtccctcgcccctcagcatcagctggacctcctccagcctccctccaaggcaccatttctggttcccacagtgggaccagggatctctttttccttctctcactggctctggtaacatctcactgagaccccagcgggagttgcagcttcctgatctggaatgatgtgtgtgtgtctgtcaccaggggggccgagctcagatgggcagggatcatgatggctgatgcgtcctggcggctcccagcaccctgcctgcttctgtgtgtgctgagtgttgactggcatgaatccttacggatggtttccatatgcaaatcatgcaaaaacccaacatccccagccccctgtcaaacccaactttcccctgaaatagctgcctctaattgcccttaacacacagcagtgtggctgaacgatgttccgtagctgtgggcattccgaaggaaaatgtgtccttatccccagttataaggggtgttgtgggccaaattacgtaccccaaaaagtcttgtccaaatgctaacccgcagcttctgtgaatatgaccttatttggacatggggtctttgcaggtgtgattaaattaagaatatggagatgagatcatccttaggatttaagttcaaatcctcaaatcagatgacaaatttaatttaatttaatttaatttatttattttgagatggagtcttgctctgtcaccaggctggagtgcagtggcacgatctcagctcactgcaacctccgcctcctgggttcaatcaattctcttgcctcagcctcctgagtggctgggactgcaggtgcagactaccacgcccggctaatttttgtatttttagtagagatgggtttcaccatgttggccaggctggtctcgatctcctgacctcatgatctgcccaccttggcctctcaaagtgctggaattacagtgtgagccaccgcacccagcgtggatgacaaatttttataagagaacagggaatactcaaacacacagaggagaagaccacgtgtccttgaagacagagattggagggatgtggccacaggccaaggatcacctggagccaggaggagctgggagaggcaggaaggatcctcctttgagcttttgaaagaagcgaggcctgtcaactccttgattccagacttctggcgtccagcactgtgagagattgaaccatgagtttgtggcaattagttgtggcatcgcctggaaactgataggaagaatacaaactcttcagagagagggaaaaagtgcatggcattagctgggttttcattgtctgctcatggactcagatttattgaacatctatttgtattagttccaagaaatagaaatactaagaatacaaagcccgtgctctgagaaatacatcaggagaaatttagtacatcaaagacagctactagctccagggacacaggtgccaggcagggcttcgatctgggtcttcactaatgcccttgtctacaggcaatcccaaggcacaagtcatctacccatgagcaaactgagccgcagagcattacacactggtggtaatttaaagaaagagtgtttatgcttaacccaagaggacctcttcagttaggtggtacttgacttaactcttttttattttttattttttttttcttttgagacggagtttcgctcttgttgcccaggctggagtgcaatggtgcgatctcggctcactgcaacctctgcctcccaggttcaagcgattctcctgcctcagcctcctgagtagctgggattacaggcatgtgccaccacacctggctaatgttttgtacttttagtagagacagggtttctccatgttggtcaggctggtctccaactcctgacctcaggtgatctgcccacctcagcctcccaaagtgctgggattacaggcgtgaaacaccgtgcctggccgacttaaatcttaacaaatggatggaaggcagccatacacaatgttggggacaggccacctggttctgggggcaggaggagcaggcagggggcctgggtgcaggtggtctgcgaggaggcagcatacagagtgttgtatgtgtcggggagctgagggggagaggccacagacatgggtacagaccaggagattcaggacagatgctgtgatgagatgggatttcttcctacagaagtcgggagagcctctgaagggttccaagtcgacagaaggactgggtttgagagagagcatgcctgaaggggagaatgcagggagaagggaggccaggaagaggctcttctccacgtgggatggtgagggccggtctagcagcacgaggtgagtgatggagggcagctctaggaggtcaggctgcgtgagggacacaggtggcccaatggatccccgagaagccacatcagctgtcaggagctttgtggacgaggtagaatgctttctgaatcctgagcactgtgcaggacatgggtcctttgtcaactaccatcgaagaataagtggtaattttcggagatgcaaaatgttgggtgcagaatgcgagtccccctcccctgcgggccgtgggctgcttggctgcggggtgagggtggtgggagtgagaacagtgctccctgttttgtgcacattgctactcactgtcgagttcagcatgagtgtggggaacagcccagccagggatttgtctcggggacacagaatgatggggtgcgcagggaagagggtgccgggccacaccctgttttctagcggacggtcgctgtggggtgatgactgcaggccccggtgcaaccttcccttttaaatcatctgaggcggcagaagcatcagctccacagccacgctgccctcttctgttctctccttagaggggagaaggattcatgtctgacttttgaacccgtgtcacctgctcccatttcgccttgccacagagtgcagcaccaggataggagtgataaagtggtggaaggtgccgctccgacttgggacctgccacatcccacatggattctttccctacagaaattcatcgccaggaaaaatgacctggtcaaagtaggatctgggcattcagggcaccttggacataatggtaccctaatattcatttgaatactgtgaaactgccaatattcaaccattgttatctgctaacatggcaatttctgcggccgagtctgtaccagccagtaaggcttgtgtctcatgttcacctcaaacaagctagaaaagagagaacataggaggttcaggcaagaaaagatgcctggtgtaagactatgcgtgtgtgtgcatgtgtgtgcatgcatgaatgtgtgtatgtatgtgtccatgcaagatcatgtgtgtgtgcatgcaacagtgtgtgtatgcatgtgtgcatgcatgagtgtgtgtgcatgcatgactgtgtgcatgcatgactgtgcatgcatgattgtgtgtgtgcatgcatggttgtgtgtacgtgtgtgcatgaatgtgtgtgtgttcatgcatgattgtgtgtatgcatgcatgattgtatgtgtgcatgcatggttgtgtgtgaatgcatgattgtgcatgtgcatgcatgattgtgtgtgtgcatgcatgattatgtgtgtgcatgcatgtgtgtgcatgcatggttgtgtgtatgtgtgtgcatgaatgtgtgtgcatgtgtgtgcatgcatgattgcatgcatgattatgtgtgtgcatgcatgactgtgtatgtgtgcatacatgattgtgtgcatgtgtgcatctgcatgtgaacagggcagggtgtgtaactttcccaagtccctttgagagggcaacacacacagctacactctcagggaatggaggaggcagcaagagggagctagtgtgaagccacttgccttggagcctggacggtgggtccagtatgagctgccctgggcacaggggagttggcttagcactaaagtcgggagctgccagcactggatttgccctagcatgggtcattttctgatgcactatgtacctgcatgttgtatctgctgtttccttgctaactcacccctgttgctaactcacctctctgggatatgagtgcaaggacatttttccatccaggccactgatgtagccccacacctagaacagcccccgaaggacgaaagctctctggaagtattcatggagtggccgatggaactaagggtgtgggcatttgagtgtagctgatttggggagtgctatttatatcacatgtgcttgacattcattctttgctatttttttctcatggaataaaacagtgtctggcacatagtaggtgctggggaaatcgttgttgattgaatacatgaaataataagaaggaatagatatcagattgttttgtttctaagattgagttgccatattaaaaaaataacaatacagggtgtacagttaactttgaattccagataaacacataactttttagtataaatatgtcccaagtaacatgtgggatgcactcatactggaaaattaatctgaaatttaaatttagctgacgatcctgtattttatctggcaattctactctaagaccatgtgaagtatataaattcattgttatttcaggaaagggagctgaaaagcttggacaacatgcctagaatcacagagccagcaagaggctggtccgctgactgatgcccctccccgtgcctcctgcctttaaaagggggcccagggacaggctcccgcacatccctacatttcccaggcaggagactcaggggcagagaggcgggaggctcgctcagaactcagcgccaggttaaagcagttctgggttggaccctgtgctcctgcccctgcccagtgggctggcattcttgccactaccctgaaccttcatatattctttgcccgatttattgaatctctgaggcgctattgcgggaaaacgccaccccacacctctgtctggtttcctggacgttgcctgaaggccagggttcctgctggccgtctgaccttttctcttgttctcttggcggcctttttacagaagatacctttacagccagctacctgggaatcgctgtgcacttttgggccacatctgctggggacaggctgcaagctgagcaaaacctgcttgtttgcttgagctgctccagataatctaatgaaagaaacagggctgattaatcccagatactctactggcgtttaatcccagtgaatgttagacaacaatctcattatgtgcttatgtcttcaacatgacaggcaaggaatgaaattaagccataaaatcaattatttctgcagaaattggcatataagacaaaacatcatcaggaggcgaaagcagtgatgattaggccttcatttcccccgtgctgattgtggagctggcaccacactcgcgatgctccccaaaccatcccgttgcaaggctgggtcctgggcacaaaatggggatttgagaaatgtccttcacagataacgctctcttcttgccacttcctctccctttctctctccttctctctccctctcttcctatctctgtgtctctgcctctctatctctttctgaatcctggtggacattgtgagctgttgcggctgcgtttggggagtcttatgacccacggtgggtctcctgtcctactgcgtggcatgccgggtcccaagggtttgcagagggactgaggagagcgtgactacataattgtacaataaaattgttatagacaccgaggagtagtgaaagtaaaacagaacaaaacattgactcagaagtcagaagacgggtgacaaagctgtgtcacctcccacctcttgagttcttggaaacttttctgccagaggctcagttttcatgtccgcacaaagtggagattgtgggaggtagtttttcaggcctggtgtgacattcctttagaacggatgctggggccgtgtgctgggcaaacctctacacagtaattaggtagccagtgagcacggctgcgagggcgtttgtcatcccaacagcccatattctcagaaataatcacccagaggagcctcggtacagagacggatagggcaggaaccaccagctcctgacctcaaacggaggtgtacagacattcatcagaggtggcagccagctcctgctgcctcatggtgcttccaaggttgaaaaaataaccttccaacacctcctgccctgacacagggttacttctggtagaggtggggagaggaatcgatggagtgagaagcatcctatgacctctatatgacctctattactgggattgttgacaagaaaaattctttaattttttacttctgtaattcacaagcaaatataagtatcgagaacaaggctatttgtagttgtggtttcaagaatccacgccagtgctgtgagtgacctgcgggtgggaagatctttgtgctgggtatgaaaccacaatgacgaccacaaaggaaagatggcatctactgatgttagaggcacttgcttttattctcattagcatttgcccaacaagaactattcaatccttttgacagaagaagcaactgaggctccagaaggcacagtgacttttccaagtcacacagctaaggatagaggcgccaggaagctggcccaggatgagagatggagagctgagattttttcctttcaggtaccactgcacacacccatgaggagagtacatctcacccatcaggcctgggagggtacgtacaaggcaggacgggcctgagagagttccccagcagcccctccctgttgcctagatctaggttatatcagtcctggacgagggcaaacaagaaggactttaacacaagacacccagatctgatgccccctgtttccttgccaggcaggcagctggtggtgaggaagggttgccggtcatccctgggaacttcacccaacagtcaggatggtcagggttggatcgtcttccctcacttaagccccgccaccttctttctcctgcgaggggctcggccccctgccccactggagctcccctatcgccacagtattgggaagttgccattgattaagattgtacggtttgtgcagatggacaaggagtcaccattgactgcaaaagcagatacagcagcagggcccttggtgtgctcttcttctaaacatatgacgccttcatcttccagccagcaccgggaaagccatcttttttccttgggtctggattgaggccaggctgccctgccctctcaatcctgcagagtgatggaagcatgtctgcagagggctgtgttccacctgcccctcacccaccaagagcctacagaaagctggcggtgactggggagcagtggaggatccaaagctcagcaagaagtccaggctggatgcctgcaaaggcagagtctccattgtccactcacaaccacggcctcacgcatgatgggccctgccacatgcctaccgaatccctgtcctcaaagggaagcactttggggtgcagggaaaaccaagtgaacacaaaccatctgcagaaggtaccagagcagcctgatgggaggacagagaaggcacaggcgggggctctgggacagcaaggggacggcccctggagagagctgcaccacaaggctaagggcagaaagtgcaggcacatgggggacagcatgatctatttatcgattcatttaaacatttattgagtgcctactgtttgttagggacggtgctatagccactggaggaagagaaatgaaggagtctattggggaaaaagaaaaagaattaaccgcacttaattatcctgcaatgatcattacagtgagagaaaggtttgcacaaaatgttctggtaatccaggggaggaagagattgaatccagggggaaagacaggatagtagataagagtctaggacctggactggaggggcacatttcaaatcccagctctgtcactcaatagctgtgtgatgctgtgtaacttgtgtaggctctctggcctctgcttcctcatctttaaaatagggataataaaaattatacctggtgtgcagtatggtgtctataggtaataacactgtatcctatacttgaaattggctaagagtaaatcttaagtgttctcacagaacaaaagaagaaaatggtaacaatgtacggtgatggctatgctaattagctaggtgatagtaatcatttcacaatgtatcaggcatcaagttatacactttattatttatttatttatgagacggaatctcgctctgtctcacctaggctggagtgcagtggcatgatctcggcttactgcagcctccatctcctgggttcaagcgattctcctgtctcagcctcccaagtagctgggactacaggtgtgtgccaccacacccagctaattttgtatttttagtagagatggggtttcaccatgttggccaggctggtctcaaactcctctccttaggtgatccatccgcctcggcttcccaaagtggtgggattacaggcatgagccaccgcacccagcctgtacactttaaatacgtacaattctaatagtcaattacaccccaataaagctgaaaataagaaataataatcatacctgcttcattaaggttattgtagtggggtgttggtgttaaccagctctcttgaaaaaaaaagatatgcatatacatctatataagcttattataaattttactataaaataatttcaatccaattcagaaataaagttgcccacatcattgactaatggctgtggttccaacaggaatgttggcagttggcaagattgcctcagtctcccaggtgatcccagcaggaggtgctcttagcagatttctgcattaaagtagacaattactgtggaagatgttaagctgtgcccatgattgcctcagcggtgtacatgacctctgacatgaccttccccagtcctgggcttccactgggttctgaattttctcggacttgagtaaattaaaccctctttctaaagcaatgggctcagcctttagggatgcatttctctcatcttgtttcctcctcttctctggtggaaatcttgtaacagttaatttgatctgcttcttaggctgattctgcctacctcaccaactgcagaaccaacactgagagctgaatcattaaacttttcccttcttttgggtccaagctcaagagttgagtttctctactgttcattcttcttccattatatggcccttgctggcacctcacggtgcctaacttgagaccatctgaacatttattaagtggttttcatttatgtatgtatttattttatttttttgagacagagtctggctctgtcacccaggctggagtgcagtggcatgctcttgactcactgcaacctctgcctcccaggttcaagcaattatcctgcctcagcctcccgagtcgctgggattacaagcgcctgccaccacgcccggctaatttttgtatttttatagacacggggtttcaccatgttggccaggctggtctcgaactcctgacctcaggtgatcctgcctgcctcagcttcccaaagtgctgggattacaggcatgagccaccacaccgggctgagtgtttttctttgttggacaacctgcacatgttttctcagcctcagataacctcaggggacatgggctgtctttagactgatttcacatagttaatattactcagtggtaatttaaatctttatttttcatgaaaacaaattctttatttttcatgaaaacaaatgcagatatgaaatggagtggaatgttcaggaatttaaggtaaataatatcattaagagctcccatgccctaagaggctcctttaggttgtgtggcttagatcatctcccccatattacacatttacttttcttctgatagaagtagttttaggaaaacatctgaagcagtgatagagaacaagcctagcagacagaactatggagcatgaaactgcagaggcagggagaaccaggttgccaaagaggcagagaagtatcctcaaatggcaccgaagatactcatcagggaaaggtagtgcctagtccacttctgttgctataatataataccacaaaacgggtaatttataaataagtttatgtagctcacagttctagaggctgggaagtccaagagcatggtgctggcatcttgcaaggaccttcctgctacagtatgacatggcatgaggctcacaatgtgagaaagcaagaggatgagtgtcagctcaagtctcttcctcttcttataaagccaccaggtccatgatggggacaccaccttgatgaccttatctaattctagttgcttcccaaaggccccacctctaatcaatgtatgatttagggattaattttctaacacatgaaatttgggggagacattcaagccataacagggagactcatgggagccctgggctggggtgtggcctggcttggtcagggctgagcttctggaaatggcagacaaggtcgcagacagtgttgacatgcaaagggctttgctgccccaccattcacagttctgctaccatgagcgtggggctgtttttgattatcaggtactctttatttatttattttttctgagacagagtctcgctctgttgcccaggctggagtgcagtggcacaatctcggctcactgcaagctccgcctccctcctgggttcacgccattctcctgcctcagcctcctgagtagctgggactacaggtgcctgccaccacgtccagctaatattttgtattttttagtagagacggggtttcaccgtgttagccagatggtctcgatctcctgacctggtgatctgcctgccttggcctcccaaagtgctgggattacaggtgtgagccactgcctcaggtactctttccttcagaaacaggctctcttttgttgcacacatttttctcatcacagagtaaagtaaatcaggaagctctcggaagaaaagagatgcccactgtagacaagctgagcagcatttagtcttcagagccaagagaataaactgttagtcaatgatttaattcaactgccttgaatcctaaacagtgttgatgaggttacattactattttggattcaggcagaaggggccatacatggaaattaagaggggaaaaccaatattgagtcaaaatgctaggctcacttaggaaacaattaaataatatctagagggaattgaatattaaagtcaaatgcattctaatgggctaagtggccttttgagcttgctctctcctcaaatcatatattcatatatttccaagtcttgcaagctctgaggcattcacactagggacagcgcatggtatttgcagaatattaagggcatgatgatgtttctcaatagttcacaaataattcaggagttgagctgcttaaatgggagctgtcgtgctgcaatgtggaatgcggtctctgtgtggtatgctggtctgcaggcttttgctgaatgcaatgccaaagcatcaaaatctagaacagggcaggagccttgccaggaactgcttcaaggcaggagcagactgaaactggaagaaggttgcagacacatcttttgaggtgcagaaagctggggacaggactggaggggcaaaagcatttcctagcaatccacaaagctggcagattggttgaaaatcaggaaaagagattcctatgatttggaaagttgatatctgggccccaaggcacaaggagagtcctggaatctcactggtgctcagatcacaggacatgctaaaggagaggtcctgatctcaccctcaaaatgttccagtcaaatgatgaactcaatctaaagcccaggcccaactcaactactgagtggatggattctccccacaccaactccccacaccatggtcgggcaggagcagggtatgctttcttctggagctaaacgttatttactttggtctacttttttttttttttaaacaaacagtctccagaataaaataaatttgacacgacacatgaagaagaaataagaaaaggagacccacggttatgaggaaaaatggccatgaaatgtctagagagggcctggatggtggcatcatctaataaataaggccctttaatatgcctatggcagctatgttaaaggacctcgtagagaggtagaaacaagctggaaatttcaccagatagatggaaactatagaaacatccaaatggaaatgacagaaatgaaaactgagatccagaatgaagattaattaaatggggtcaccagcagattgagcacagctggacattgcctggtgtggccccaggccattcttcacttgtcaattctccttggactcctgggatggttggagcgtgtcccgtacatggcaaatggataagcaacagaggacaatggacaacgcttgctgtctgatattgtctggccccatgtccctacccaaatctcatctcgaattgtaatcctcataattcccacgtgtcgagggagggaccgggtaggaggtgatttgatcatggggctggttttctgcatgctgttctcgtgatagtgagtgagttctcatgagatcagttggctttatgtttgaagttactccttcacatgcccttctctctcctgctgccttgtgaagaaggtgcttgcttccccttcgtcttctgccatgattgtaagtttcctgaggcctccctagccatgtgaaactgtgagtcaattaaacctctttcctttataaattgcccagtcttgggtatttctttatagaagcatgaaaatggactaatacattgtctcatagagtgttgagtatgtgtgggtcccctgtctcattctcacgtgtcatttccaaaacagatcatgagccgaaccaaacatgatggcatggtgaaatatactcctccccttcgagtaggaggaattacaaggttatgtagcaaatggcatgaattaaaatcctgttaaggagggattgaagaattagtgaagaattaggaatgataatctaggctaaaccccaaagaaggcaggccagtgaatgaacctgagtgttgtaagaccttgtgttgttcaggaggtggtaaaactactaatgtaaggttggtagtaatataccaattgtttctattataatatatattttagtcactaaaataataataaatagatatgtaacaaactaatagcaaagaaaatggaataataaaacatactgaaataaaattgtggggtggagggaggggggagggatagcattaggagatatacctaatgctaaatgaccagttaatgggtgcagcacacaaacatggcacatgtatacatatgtaacaaacctgcacgttgtgcacatgtaccctaaaacttaaagtatgataataataaaataaaaaagtagcaaaaaataaaataaaatgaaataaaataaaccaagaagagaaggaaaaaggaaaaagccaggaacagatagaaagcaaaagattagactatagatttaaaccaactacgtagtaattactaggttgaagcatatgaaattatctcttttttgtttaaaaaatctaatattgcagttccacatggttcaatctaatgcactaaatgaaaattaactacatactccaaataagaagcaaagatgatcacataggattcagaaatctcagataacaacaacagtagcaagtagcagaaattaaactgaaatggagcaaagaaaggtgaaggtaaaacgataccaaaagtacccccatgccatcactaactgaagaaaagcttccacagtttaactaatatcagacactgcggactgcaggtggtgagcgatgttagaggaagagaggcatttcataaccacccaaaggccaattcaacaggtagataaaacaattatcaataacagagcaatccacttcatataatatcaaagtatgtgaaccaaaaagttacagaactaagagacagactcatccacaagcgcagactctcaggggccgctgacccagcgttcctacttctggatctgtgctcaacagaagtgtgaatacatgcacagcagaaggagaaaagaagctttcattgtaaaagcctagaattcagaatgtacccaatgtccactaacagtagactggatacatgaactgtggcatattcatatcatacaatattatatacgatacaacaaaatatacagcaacacaaagaacaagatatggctaaacacaacaaacaaatggaccttacaaatacaaagttgtgtatgcaccatatcatttacggaaagttcaatggtattaaccctgagagagtcatgaggaaggcttatggaaggacagtaacatttaattttttatcatctgactcgacacatttccctttataaaaaaccagtgagctataaacttgatttgtacagcttacttcatttatgttctgattcaattaaaaagcctacaaagaagttccatcaggatttttgaataaccatatcagacaggtgatctgactgccagaagaaagtggatggcgtgaagttaaggtcttattcacatgagcccatcctggatttcagcttccatagcaagcatgctcttcaaaggaattaaatgcaaaccagcgaggatgttttacaataccaagggtggaaatccaacccaactccccttttgtaaaacaaagcagtcactgggatcgatcatacactcagcattcaggagtatctggaacccagaacgtcagcaccataggaatgccttctctccctcacccgtcatatctggaacccagaacgtcagcaccaccgtgatgccttctctccctcacccgttccaggtctcatcaacagacccaggtggtaacagcgctcccagctcctctcttctctcagtagggattactcttcctcacccgatgacatcaggcttatcaagacttgtctggcccatggaatgtggcagcactgactcccttggcctttgacaggagccttaggaggcactgactgggcctgcctcattctccatcgtcctggctcatgggtccttcagacagagactcttctttctgctagaatcccaggatgaggaagcacccggagcagcgaccctgcagctgatctgtaacataagaaacaaaggtttcctatctcaagccattgacacttggagattgtttgttaatgcaattaaaaattagcctgtttttggccagatgtggtggctcactcctgtaattttagcactccgggaggctgaggtgagcagatcacttgaggtcaggagttcaagacaagcctggccaacatggtgaaatcctgtctttactaaaaataccaaaattagccggaaatctcttgaacccaagaggcagagattgcagtgagctgagatcatgccactgcactccagcctgggcaacagagcaagactccatctcaaaaaaataaataaataaaaataaaatagtctgttctttttgcttaggattgtcttggctatatgggctcttttttgcttccatatgaaatttaaagtattctaattctgtgaagaatgtcaatggtagtttgatgggaatagcattgaatctataaattactttgcgcagtaggccattttcatgatattgattcttcccatccatgaggatggaatgtttttccatttgtttgtgtcctctcttatttccttgagcagtggtttgtagttccccttgaagaggtccttcacatctcttgtaagttggatgcctagatattttattccctttgtagcaattgcgaatgggagttcactcatgattatgctctctgtttgtctgttgttgatgtataggaatgtttgtgattttcgcacattggttttgtaccctgagactttcctgaagttgcagggaacaacacacaccagggcctatcggagggtggggagcaaggggagggagagcattagggcaaatatctaacgcatgtggggcttaaaacctcaatgacgggttcaaaggtgcagcaaaccaccatggcacatgtatacctatataaaactgcatgttctgcacatgtatcctggaacttaaagtaaaacttaaaaaaaattagcctgaacactgcatgttctcacttacagctgggagctggacagtgagaacacatggacataggaaggggaacaaaactcactggggcctgttggggaggggcttggtggggagaacatcagggaaaagagctaatgcatgctgggcttaatacctaggtgatgggttgacgggtgcagcaaaccaccatggcacacgtttacctgtgtaacaaaactgcagatcccgcatatgtatcctaggacttaaaaaataataataggccaggcgccgtggctcatgtctgtaattccagcactttgggaggccaaggcaggtggatcacaaggtcaggagatcaacaccatcctggctaacacggtgaaaccccgtctttactgaaaatacaaaaaaattagccaagcgtggtggcgggtgcctgtggtcccagttacttgggaggctgaggcaggagaatggtgtgaacccgggaggtggagcttgcagtgagccgagatcccgccactgcactccagcctgggcaacagagcaagactctgtctcaaaaaaataaaattaaattaaataaaattaaagaaaattagcctgaactgattgatacaacttgtaccacatacagagacatgaagcctggagactctgggattacatcctaataactctgcggcccggtgaaataggcctacctgccctgtaaagtttataccatcccgggtctgtaagggctcatgtgtccacttccagaacaaacctctggcaaggatggatttctgtaattactctgggttagtagtgtgacaatcttgaggtcagagggagcagtcttctctgtaaattcacagtttgaacaaagccttctgaaagagatcattgttttgctttgcatgtacaaacaataaatgtacactgtagttatcacatggagttatgtaacctatttggtggttatttattttgtgaaataccaaccaatgggacaagatccctgggcatggtcagggaaaagaacccagacatctcataacctaagggatttcaaacactcataacacttctcactgtgagttaggctggttctgaggagttttctcattccacgatgtgctgcatagcatgtggaccagccaactgatctttgcctgtagtatatacattttttgagacagggtctcgctctgttgcccaggttggagttgcagtggtgccatctcagctcactgcaacctccagctcctgggcttgagtgatcctcccacctcagcctctcaagtagctgggactataaatgcacacagccactcctggctctgtttttttgttttattttattttttagagacagggcttactatgttgctcagtctggtcttgaactcctgggctaaagctatcctcccacctcagctttccaaagtgctgggattacagtcatgagccaccgtgcccagcctggctatactattgacctcaggactgccaccatccatggctactgaagagttggataatttcgtctacaaaattgaatacatgtttgtccttgaacccagttgtctttattgtttatcaatgaatgctcccaggacaaaccctgctttccaaaactgaaatctgagattcactctacccctcttgctaccagagcccattgcattagttctctgttgctgcttttacaaattaccccaaatttagtggagcaaaacaacacaaatttattagcttatagctctacagtcagaggtctgatagagtctgaagcatcatcagggctgcctgcctctctggagacattgagggaagtctgtttccttgctgtttcccgtcttagaggctgtccacattccttggcttgcagcatccacctctatctccaaagccagcaagacaggttgaatctttttcaccgtgctttacggtgaccttgcttctgttgtcctttctctctcggactttctcctctgccactctcctcttttgagacccctggattatgttgcctccacctccagggaatccaggataatctgcctatttcagtcagttgattagcagccttaattcctgcaacctcgattcccgtttgccctgttatgaaaccgacccgtttgcagcttccaaggagtagggcgtcggcctcctttgggcgttattctgctgaacacaccaagtgaacaccaacacctgccgacccatcttcttaacatcctgggtcctgcaggggttcccactcacagctccagttccattctccaccctccctactttgagctgtatgtttagggaacctcatttccaggtctgcctgggtcatggctccttttagtctcagcagatcctggtttggataattaattagatggttactctatcctgctgcacgtgcctggccacttaatagttccccagccatggggagccgcctcacatctacggcctttctactgttctgcccttccaggagatctctgcattccaacccacatccatgtggaaatataacttatctttcaagggtaaactgctgtgtcccatcttttgtgaaattgtcctgttctgtggaggtttatctgatcatatctgctcttatgctgagcttgcatctcacatggctctgatacacagtgtcgagtacaatggaactgtgtttgttatttctcctctcctgacgccgaacttcttgaaggcagaggtagctcaggtctccaggcacaaatcaaagagccctgcatgagtcaaatctcagtaagcaatggatggagttgaactaacttggcgtccaccctcttttataaaaaatgaaaacccttagagagacccagtctcctccctccattgcacataaaaatcagttaagtccgggcgcagtggctcacgcctataatcccagcactttgggagactgaggcaggttgatcacgaggtcaggaattcgagaccagcttgaccaacgtggtgaaaccctgtccctactaaaaatacaaaattagccaggcgtggtggcatatgcctgtaatcccagctactcaggaggctgaggcaggagaattgcttgaatctggaaggtggcagttgcagtgagccaagatcgtgccactgcactccagcctgggagacagagcgagactctgtctcaaaataataataataataatgttactgtacagagatatcactaagtacttattagggtctttttaagttttattcattaaaaactataagctgttaagtttagaagaattatatatatcttaaaaatcactgttatgtcaacccaaaggaattgattgacctaggcaatgatcatcaatggatacattcattagatgaatgatgggtggagaatttgacaatggacaaattaaattgctaccacctatattccctgattgtccctcaggataggacaaccataaagtgtgtccccagtgtgaaaagtactctttagtatcatatttaaagtattcatatttaaagtactctttagtatcatatttaaagtattcatatttaaagtactctttagtatcatatttaaagtattcatatttaaagtactctttagtatcatatttaaagtattttaaagatgctaaagtatcatatttaaactattcttgctcaaaacattacatcttaaactactcaaggttctaccttccatttacaaaaacatggggaatagaagatgaactcaaatgacaccacaaggaacaaccagacaaatcatctacggctggaatgtacaggacaagtaatataatgttgggaaaaaagttaatgcacaaaacaaaagggggccagggacttctgagcaataaagagacttaagagactccacttgaatcaatgtgtctaccttgttggattctgattcaaactgaccgactggataaagatgttcatgagtgggcagagaggcatgactatgggctgggcatggggtacatgtaagaatttattgttcattgtgccagatgtaataatggcattttggttatagataaaaacttctattttttagagctatacactgaagtctttaggagtgaaatgatacaatatctgacattcatcaaaaacagatgcaaaatgttataaatgaatagatgaagcagttatgaaagataaaacctctctacctttaagcacgtttgaaattttgcacaaaccccttttttaaaaatagaaatcattgattgtatgtctaaaatgattaagttagtgaataaaatagttttctcccaactatgcagcaaatattttcaccagtaaatggggaagtcagacctgagaatcggggaaggctgtttgagctaactctgtcatgatacataatcacctagtgccgtccttattttacacttgacaggttatgtggccaagcagctttcgtgagttgctgtaaactctgtttctggtctttccaagcagcaggccagcttccctttcccctctaccctccacagtgcctcccacagtcttcttcacacaatagatattcagcacttacccttcgagtgaatgaggggatggatggctgggtctttgcacacttgcgataccatagcttatgaatgaatggatgaggctaataaaaaagaccatgttttgcactgaaattgcttcatggtccttctgggtccagagactctttatctatagacattgtgtctataaatccatatctaccaggccaggctcttgagtgaatgacttaccaacatcccactgctgccccaaggattctgaaagacgaagagaccattcaaaatcaaagggaagattatttccccactgagagctgcatacactgaaaggtagggagctgagggtgaaaaaactcactactactagatctggtgtagttcaagttcatgaatctcagcactgatctctcagcctgtttcttgcataaataaaacagaggcactggtttgcatgagaatctcataatgcgctatgaaatccatgccagagtcaggcatctaatttaagaattatttctcgattttgtgtctcacatcctgcttctgcctctttctgctgattggattcttcccttccctttccctaacaagcttgtctccccctctccctgcacctcctcctctgatctttccctcctgccttcacctcttcctctctccctaataaagtgaccctggcctggctagatatctgtgagttggcagagaggtcaagacaggtcatatgccaaatgccctctccaccagatctggggcaggtgggttgggtttagaaacacaaggaagagatgtgggctcagcttgggttgggtctccagaagtctgggtgctggcacaggctctgtgactgacaaggaacaaagcacaatctgttgtttctgagccttgtctccgcctgaggacctcatgctggtcaaccgtgtttctctctctttccaccgattctggagacaaggctcacagctgagtagagaggaagcagagcagtagcaagggtgctgctgatgctgctcagataccttgcctggttctgacaagcggtttccactccccacccagttctacacgtgtccctgcactggggaaggctctctctggggtcacggtgggtgggggacagcacagccagagtccctgtattccgaggacttgggttcttacgaagggagacggataataaacacattagataagtacatgaacaagtggatgtccagcacttactgcgctttgggaaagatgaagatgaagtaatgcctcagagaatgttcctgggggtagagaaggaggagatgctgagaaaagctccaagtctccgggagaaggtgacagctggccgtggcctcaacgaggagcggccgcatggagatccaggagaaaacgtcccaaacgaaagaacaagcggttggtgccctggatcaagagtgagtctgtgggctccagggccaaagatgtggccagcgtgggtgtgcattgtgggtgaggggagatacagaggaggatggagccagctggggtcaggcctggattcatgggctactatagcttttattctgagtgaggaggttttacgattaaggtgttgtgacctggagagccttatgctgcttccaaaactcccgggctggtgtagaaaagcagaagaggaatcaggtggctagagaggggctgtcctgccaatgtgggcacaggggatgctggcttggaggagggccacagctgtgaaggtggatagcggtgacgggctgtgccaaggttttgtacatgagctgcaaagaaaaacaccattcagagaccactgacttctggtctgaacatcaggtgctggtctatagttttccaaaacagagaaaactagaggagccacggatgtacaggataaagtcaacggctctgcttttccaggaaagactgtgacacatggaaaacatccaggtagaagtgtcgtggggtagctggatgcacaagagtctgaagctcaaagccagggctcgggctgcagatagaaacttgagagttctcagcacgtagacgttctctagagctgggactaggcaggtcacccaaggaggacacacagctagggacaaaggagggatgaaggaggggcttgaagtggtttccctggagctgagattgcagagaggagacggggcccacagaagagatgaggagggcttgttccagacaacatggtgcctctttatcaagcacagccatgaatcctggaattcatgtcagagggagccactgcagaacttggaaaagtggcaagaggaaggcgaactgtctggaaaccaaacccgagtgtcggaggaagagcagagtggaagggtgccttctgcccccaacccaacagaagcaagggatctggcctttcccatcccccaggttggcaatggaagccagccttggtggactcattcctgtcctagacccaagcggagtccctcctatagtaacaggtgaacccagacccgccaccaggtggatcagttgggagctttgccaaaagtaagtggcctgcggagactccttccctatcaggcctgagaccccccctccccaacctagagatgcaggcatagctgggacagtggcaagagggacagccaaaaggaatggtgaagcctgggaatcacctctgccctgcaagcctgagactcctctccccacacggacagtggggacccggggggtggtcccagtggggtggggagatcccaccacaatgactatccagccaaggaagcctgagactctcctccctcatggagagatgcggatgacctggtctgcagaagctcctcctgccctgaggtcgctcccacagggacccacggaagctcctccagcaccagatacaccaagcagctcaaacaatagcacaaagactctgaaaattaaactgtcattagaaccccagcccacaaaagtaggcaagagggaaactaaaagaatttgtggcttgcagatttacttttaaagattggataaagaaaactctttcaacagaaaagaaataaaaaatgaagaaatcatgaaacatcagaaaggaagaaaacaggagcatgggtaggtatcatgagcacactattcccttcctcctgaatggtctaaatcacacacgatgattgaaataaaaatcacgttaccatctgatactcaagacgatatttaaaactggtgagggcaaaggtgcctgaatggaagtaaggtgttcacacctcacatgaagacacactgatactcatagagaaaaaatgcaaagcaattggaaggctgggcttttcaacaaatggtgctggagcaattgttcatccttaggaaaattaaatgaaccccccaaactaaacttcacgccttatacaaaaatgaactggaaatgattcatgaacttaactgtaaatgagaaatctgtacaacttttagaagaaacaatttaaaaatattaggaatcttatgctaaaaaagaattcttcaacaacagcaaaacaatccatgaaagaaaaaatgtttaactgaacactttgggtcaaaatgatgattcttttttttttttttttttactctgaaaaaaagccatgtgaagaggataaaaagacaagttacaaacagggagaaaatatttgcaaatcacatatctgacaaaagattagtatctagagtttataaagaattcttaaaattcaacagtgaaaaaacaacctgattataaaatgggcaaaaggcatttggagacaatttcatgtagagtatgtacagatggcaagtaagcacatggaaaatgttgagcgtcattagccattggaaaaatagaaattaaaactacaatgggatatcgctgcatctctactaaagtggctgaaataaaaaaatagtgatgatcctaaatgctggcaaagatacagagaagccaaatcactcagacatcacgggtggaaatgcaatacagccactccggaaaacaaccgggcagtttcttacaaaacattcagttgcattcttgggtatttactctaggaaatcttatattcacatacaaacctcgacatgaatgttcatagaggctttatttgtaataaccacaaaccagaaacatcccacgtgccctcagtggttaaacaaagtgtacctaatgccatggaaaccacttagcaataagaaaggaattcttgtggtgatagactcgttctgtgtctagactgtcctggtgcatatgtgaacccagcatgtggcaaaaatgtgcagaactaaatacacacacacacacacacacacacgagcaagtagaactggaaatctgaataagatctatgggttgatcagtcaataccctggttgtgatgttgcactagttttgcaacatattttctttggtggaaactgggtaaagggtacacaggatctctctgtattatgttttacaactgcatgtaaatctgcaattcaataagaatttttaaaattttttttatttttgagacggagtctcgctctgttgcccaggctggagtgcagtggcgccatctcagctcactgcatcctctgtctcctgggttcaagtgattctcctgcctcagcctaccaagtagctgggattacaggcatgcaccaccatgcccagctaatttttctatttttagtggagatggggtttcaccatgttggccaggctggtctcgatcttctgacctcaggtgatccacccgcatcccaatgtgctcggattacagctgtgagccaccactcccgacccaagaatatttctaaaaatgaaaagagagaagagcggagatacaggactccagttgagtagagtgacacagaagaaacaagatgagaacaaatttacatgtagaaacactcatcaggtatgttctcagtgcttcctgtaactcgctgaaacttcacaggatcccatgagatgagaaatgctattttatttggcagaggatgaccctaaaatgtagagagattaaataatgttcccacagtcacacagttgataagccctgctttcatgggcagcacagcgtagttgtggaaggaaacattaaatagtccaccaagtgacgtgtaaatggtaagtgcaagacagtaagattcctgagggcaggaactcagtgcatttgttcgctgttgtatactgagcacttaagaaaaggcctggcatggggcaggtgccaggaaaagaagcaggagccagcaatctatggggaacaggctatcagttgaggagcggagtcaggcatgttttggcaaatgacatttaagcagacattggagtgatgagtagcagttggctagatcagatcctcattccaaacattccaatgggattctatctcccttggaatgaatccaaggtccttatcctacaaggcttctgggacctggctcctggccatctctctgccctcatctcctcctgccttcttctcttcctgtaggctcccttccttgaacatcccaagcccacgcccatctcaggacatgtgcaccagctgttcctgtagcctgaaatctcctccctcaaacacacaggactcaactcactcccacagctccctgctcaagtgtcgccttaagagaggccatccccacccacccacataaaatcatgtcccacctgtgtcgttccacttccctgaccctgccttattttccactgtgcttcttcccaccatctggaagatatgtttgctctctgcctcctgacgccgaaaaagttgtgtacacagggacatttctctttggtttgtctaatgctgcatcttcattccccagaagggggacaggggtgtgtgtgtgtgtgtaatggttgaagagaagtggaaactgggcatcagtgcatggatgtgcactgactctgtggctctgccactgcacggggaaatgtggttggtgaggtgaggcagtgaggagatgaacccatgccagtcacagtgtgaactgagagcccacatttcatgaaagcagggacctggggaaagagaaactacttcccatggccaagggagatgccaggatcagagtctttgtgaagacaaaatggaagtcttcctggagaaatcaaaacctaggcctgcgcctcccctgtgtgaatctgttgcccccttgtggctggggattacctaagccaaagaaattttcttctaggttcatgtgaccccgagattggctgggagaagtaaatgtagagcagagctagaagagaaaagccttaatcaaattattgcatattctcactgaagatgagctcataatcccaaattacaaaacatacgatgagtgagagaaaacagacagtgtgagcagccaggtttgatcaatctgaactagagtataaagaagtataattacacaaattaagggcataaaagtataaagtaggaaacagtaagtagaattgcaatagggccaaatagaacttctagaggtaaaaattacacacatacagaatctaaggcccttggtcatgttgaacagcagattagatatagctgaaaggaaagaattaataaggtgaaagataaaaccaaggaaattaaccaggatgcagcacagagagataaagcttttgcctgcaaatgtctttattttgtcctcactgttgaattatcgtttagatagctggaaagagacttgtatgtttactgttatcttcccttggcacattcaatatattatagactttattccattattgtatgaccttcatttacttatcatttacgaacatttgttgtaaacctacagtaattaggagagtatgatatcaatgcagggatagacgaatgggtaaatggaacaaggaaggagcccagaagtagatccacgtatacattggtataaaacagagtcagccttacaattcagtaggcaaagagtgagctattcgctagtgttgggacgtaggttttccatatgaaataaaaatacaatagagctataacccacatcacacatacactccaggttgattaaagaactgaacaactaaagcagaaccctaaacctttcaaaactcaatagaatatctgtgtggcctctggttagaaaataatatcttaaataagacacatgatgtgcatatgcgataaagaaaaattaaagtatcaaaacttgcatccagacatctaaatctcaaaaacataatatggatcaggaacatgaatttcaaagtatacataaaatacaacataagatataaatgacttttaaaatttaaaaacatgtggagcaacgaaatctgtaggttctggataaacatacatgtaagaatgttacacgcccacaaaattaacaatgctgaattcaggataccggttgctgcttctggaactggggcacagaggcaggttttgggctagaaacaagtgaatgaggtacttcaaccctaacccttaacgttttatttttaaaagaaagtcatccaaaccaaatacagcaaaatactgtgttttgagaaattcaagtggcaggtatgaaattattcatgattccctatatggctgcctgaaatattacacagaaataaaggaagaaaatgttaaatatgtacataagggtgctggaattattaactgcggatctgaaggtacctggaatcaccctggtgtgactattccttattgtttctctcctctagagagtctctaaatgagttgacctttttttttaattagtcaacttcaaggtgacaatctgttgctttcaaccaagcgagtgctgactgatggagaatcctgctgctgcatcctgcacaggcgctcctggcacagtaaatcaccgacctgatttctgggcaaaactcagcacattggactccttgtcttactggatcgtggacattctcaacaacccctgcgagccaggggatcacgcggaatctcagcagttctctgggatccactgctccttcctcactctcatccaaggggctttgccagcactgagcaagtgacacccaggtcgccgcatggccgctcctccccctccgctcctgcctctaatctcctcctgcggaacgggtgggagctctgggcacttacacttatttatggtcatgtactgctggaacttaatgatacataaatctcaaattatgaagtcacagctctccatattcctggctcaaaatgatcctcaggataaaattaccagggaagcaaacaggagggcaccgtctagtgttgaggattgctctggatagctgggggaaacaagtctttcccaggaagcacatgattcaaatgccagaggatttgctcattcttgaataaatgaatgaatgtgtgaaagaagacatctgcaaaaatacatgttcttattattcatgtttacagaagaaggaggctcagagacacaatgttgacagggccgaggcctggcactacagaattactgacggacagatcaatcacttctctctgaggatacagcctggggagcattaggatcagcttactcagggcacctcaccctttcttgctaccagctctagagtcttgtagatgatcttgagaatctccctagggtttcttgcccccacctaatttccctaaacccttcctcctcctgacttccttttcttctccatcaagtcctcagcctaggttcatttttcctctatagacgctggtttctccttgctctgacctcgtggcatttcctttgcctttccttcctcgtcctggctgagatccagctttgtgtccttcatcctttctcccctgcccctttctgcctccccagcttctcacggtggacagagacattccgagatcctttgctcggttttctctttcaggctggagtgcagcaggctgggcatggctgccttccttcctcacatccccatgctctggaaagccctcagaggacctgggtctcacctccacagtcccgtggctccctgcccctgcaggctggactcgcccctgggcttggaccacctccagccagactccagtggtgtgatagagagggctcaggatagggggttctgcgaactgactcatcacccccaagcaagtgataacctcactaaggctcagtcctaataatcctgctatattaacaacctctatacttttgaaactgacccctagtcccataaacagttttttgtttttgttttgataaacatagaaatggatgcttctggtcttaaagcttgaaacttgtatttgttttatgagttcctttttcaggaaagggcccccaggcctctcaaaagcatcaaagaactgaaactcactagatcatctcatccagacagtgagatgtcagacccttcattcaccctgattgcttccttacccctctgagctcctcttttcccatacattgttacatttcttccctgctatataaacccctaattttagctggtcattgagatggatttgagaatctcctgggctgcagcaccaataaagctttcttccttggtgatactctttgtctcagggactggctttctgtgcagtgagcagcaggacccagaaggaacccatgatgttttggtaacacctgttgtcgacttgtctctaaagtgtcatgtagtgagaccccgtctcagaaatacactagggactcagagtgttgccatgtcctcggtagcttttgggattagtcttcatttcattcacatattaaaggctgtggtttttgtgttattgccttgacagccagtgcctggttcccttccctgagtctttttcctgtctgggtttcctcttcctcacccttctgttgtagaactcacctttgcctttaccctgttaaagaaaaccagagctgggcagtagttaaaagcggcaaaatatattttactcacgacaattgcagcaggggaaagagactttggcatagaactggctcaagtccaaacatagcatgacaaccggggattcacagccagggaggagggtggggtcaggggatgggaagtcactgagaagacatcagggtgagggggagtctggctaaatggacctaataggattcttgctgaagacagaccaaggtgaccgacatcacctgggggatggtggagaacaggaatttggtcagatattggaggtgatcagttatggagctggggatttttggctaaaccgacttgacggagttttgctaaaactgagcgatgcaaagatgagcagagacaccctcaagggtggccgagtctagaagaggctcagaggagcctgacagcaggcagcccctttctctgttctagaattgagagccctttctctcctttgcaaccgacatgccacatctttgtgtcccagggccccaagggaccagcctgtggcctcgggctgtctgaggacctccccacccaggcttctgtgagttttctgtgacttcccttcctggcgtttctctcctcggcctcagcgctgcagcagacatggttcttgggtccagtcacattagtgatgaatgaccctctccagcctccactgcctggcgaggtggagcccatgatcaaagttgccctgaaggtggagccctgcagcggcagctgggcgaggcccggggcatgtgctcaggaactgcatcaggaggggcctcttctttctccccgccttctgtgccaccagctctgtccctctatggggcagccgactcacacccatagagtgggctaggcatgtctttgccagtgccatgagctccctgccccttctgcatgagactctgtggggtgcaggcagcagctcagtcatcctctctacagatgaagagaaacccgggatgccccatggccacacaccacaccagaggcccagcaggaaaaaactgggcctcctgattcctgcctttcttcattccatcacacgcaaactgctggagcgtggtgctcaggaagagccatcgggtccctgagctggtccatgtcactccaaagtgaggggctcctgcaaacatggcgtgtaaggagcgggtgtttaaaaaatgggcacttgcaatgaatttggggtcagctctacttgcagtcccagtcagaactatccctccctacctgccagccaccaccccacaccccaccacccaacagcccaccatacatactcctgagacagacattttaatatattttttctactctctaccttggctcctggtctctggacgctccagggctctcccagcatagcgccagggccttctttaattaggagcggcttctctgtggttctataaaggtccagcagcccaggggtttatataagatcaggaatggccatcagtgatgttgatttcaagaacattggggctactgtgagacagaccgaggagctcagcatcactggcatacacattggtcacaggcacatacaacaggccacaggtacacacaccaggctaccagcacacatgccaagacacaagcaggaatggtcaggaggggttgagccccaggacgagctggataggttcttcctttccccaaaagaacagataaaagtagcaggacttgtgctccaggatctgactctggtcaccgcaggcctttgctcctacctccagcctccaaggcaggggccagtcaccagcaaacccattattttcaagagcatgtgaatgcatcttccagcttcaaattcttaataatcatttagactatggaaggtgacattggtattcccattgtacagatgaggaagctgacagctcaggaaggccagtgattgacatgaatttacacagccctcctgtagggccaggtttcgggccctctcctgtctgttccagtgtcctcttttaattctctcctttgcagagaacctaccacaatccctgcccagggaaatccgctgccggccacattgaggcacccctggaggaggacggggaggcagggagaagcagagtctcagccccggccacactgctgtctgaggcacccctggaggagtacagggaggcagggagaagcagagtctcagtccccagtaccccaagtgaggaccagggtgtggagaccagcagctcccctgggatcaaaggcatgtcctattcctgggggccgtgcagagccctgacgacgtgcatgagtaaaggctcacagtgcctcatccgcctgaaggatgctctggggagacagcagctcatctccaagtgggtcagagcaagttctggagacttcctctctctcttttgctctcaaacaggcagcacataaattgagctcccggtgacctccaggagagagagatcaccagggagagaattgctggtgcacccgcgggttgctggcagtgagaagcacggagcgcggcagggagagggaccggcatgaggactccttggagcccttaagaaaggtgctgcttcctttacctttcaagttcataaagttttgttcttctaagttgtgagagaaaggaatttgtgatttatttgagaaggttttctgaaaaatctttttcacagttagccaagagctgacctgttgggaagatagatgaacagctcgagtcataaagattcctaagtgacgtttctgtgcaggttattttcaggggggtcattgccacggaattgcaactgcagacccgtacttggcacctggctctgttaggaaagaaaaacaggtgtggaagatccagcccaggggccatgtgcaatgaagattttcatttctcccggtccctgggagatagacacattcatctgacctctcaaactcataactggccccaacctcctgtgcaggagggacagggcataaggccaacgttagaagactaagcacagtcagcacagtcctcctctaccgaggctgggcagctaggatggaccccacatccctcagatctgtggttcagatccttggtcccccagatgctccccaagggccgggctccgagtctggtattttccttctgagatctgggcacaaccactcaggccagaagggtgctatgggacttacagggggtggggaggaagctaaggaattgaatctcacccgctttcttactgcacttatgttccacatctgaagatgggcgtgtgctgactacgttgccttgttcgtagtggattcatttgctctaaggtgtcactgattgtcattgattacttatgtaccataagacaggaaaaatgaaattgtcaacgtggatcaaagcaaatgacctaggcaaatctcaatcattttaggtttatttgccaaaattaaggacgcgcatccaagagacagatgtatgcctttctctgaagatgattttgagggctttaatatttaaaggggaaagggcaggatactgaaaaatacataatttcatgtgccgggagggtaggagaaacagccattcatgcctttgtctgcgtcaggcaatctgcatttttacataaggtaatgtagacaagagggcagaggaagcaatgaaatatgcatttgtctcaggtgagcagggggatgactctgagttctggcctgtgttcctgtgtctgggaagataagcgatcaatttacgttgcaggatgcacttcagcagaactgttttagggtgatgatcttgggggccaccaggaatttccttctgggcaaaatgtgagggaggtatgtagcttttcatctttgtagccgtctttttcaggagtaaagatgggagacaggtttgtgtggtccagttcccagctcgacttttccctttggctgagtgagttcggggtccccagatctattttcctttcacgcccaattaaatttatctatgcattgctctcccataacttggaattagtatattagtatatatcacatactttaaacctatatcacttttgtgggtacataaggaaaacagaagtggaataaatttggtaatgtatttgtgttcatttcttatcaatgtggtaacaaattgtcactaatttcgtgacttaacacaacacacatttattattaggttggtgcaaaagtaattgcagtttctgccattaaaagggcaacaaccacaattgtgtttgcaccaccatagtatcttgtggttctgtatgtcagacttctgacatgggcatcaccggatgacagtcttggtgtcacagggctgattccttctggaggctccaggggaaatccatttccttgccttcttcagcttctaggctgcctgtgttcctcggctgaaggatccttgcttccctttcaaagccaacagacacctaccatcttgaaatctctctgacctgaactcttctgcctcccttttctacttttaaagagcctttgattacaccggccccacctggatcatccaggccactctccctatgctaaggtcaactgaggagcaaccttaattccttctgcaaccttaatgcctccttgctgtgtaacagcattcacagcttctgggattaggtcatggacattttcaggggccattattctgcctaccaatcgtagtatccttaaaactttaaacaagtatttacaacccaacactctgaaacttttttgattaggaattgcctatatttctgtttttcacaatcatcctctgccctccagagcatctgggcagcattcatgaagggagtgccccacgtgaagatccaggatttatttcccagtcactgcacctgttctgcaagctttggcatgcatgcctagacaatgaccattacataaagaccactgtgtggttaacagacatggcaaggacatccagatttcagaggttttaaaatgtggaagaagatgtatcatggaattgatgaaatatggcattctttaatattacagacaatgagtatcagaaagcatttgatacttgatagcatttgatacttaatcagttgtaatatcagcttatacttaaaattatctgtaagtaatatatgtaagtaagctttatgatggacaggaaacataattttctttatggttcaaagctgtatctgaagttcctggaagaatatcaggaacaaagtaggtgttcaggaagtatgtgttgaatgaatgagacatattaattaagtgaatgggctaatggatgaaggaataaatgaatccattcagtgaaatctattattattttattcagataagagttattgagagccattaagtgtattaaattatagaatgctgcatgttgtctgtgtaaaggatgccctttgagagatagttatctcctcttcttgcctcccattcattcagcaggacagagtgacccagaagagcagagaggccagtggttcctagcccctcgcacacagcatgtgctcattgaaaactgtgagtgaatggagagtggatggagccatggacacttggacagatggatggatggttgcacagatggatggttggttgtcagcataaagaaatgcctgttaacggggcctctgatgcttttggttatcctccagtaggaaggattatggatgatccgttttacttgccttgaactctgggtggcttagcacacattcttggaaacaaagacccatggataccctcatgagatgacccagaaagtcaggactttccagagggagaaggctgaagaaacactgagccataaagctcagaagatcccaggctgcaaagccatcgactatctgaaggaggccggccccctttactgcaggcactgctggctctgagtgtgtctgtgcctgctggctgattccctgtgtgtcagacccgggacacatcacctcggggtgagaatgtgtaacatcttcgtgtgtgggtgtagcagctgcagtgggaacatgtctgaatgactttgcacagttctggatggcaaataaatgtttaaataggtgcatcctaggaggtacacttcagatcagctctcacagtctaagcatcacttcctcatgcaaagcactctctgctgggctttgacctcttgagctccttccctgttatgtaatagtatctaccaaccaaatgaaaactgggggtgccccctaaggctccagcctgtgaaggtggagagcctcctgcagagtcacatgtctgcaaccttgttaggttgtgactctggcgattccatgaggggtgagagttatggctggtaacttagtaatttgcatgcagggagaagcacccaagatctgttgattactcggcccattctttctgacccagtcaaagacgagcccttcctggaagaagccacgtgggccccggggagggaattgtgttagtaaatttaccggctcatcctcttccacatccatgactctgtgggcagagagaaaactcagagtcccaaaaaggtgccagcagatcaaagggaggtgtagacttaatttcaggataacatatttatacaacatcttttatttttagaatttcatattggggtctaaaacctcgaactccagtggaagaaaccacttgcatttccaagggggtgaccctcgaagttctttttccaggggaaagacatttaatttcatcttgtcttcccatatttgttcctgttagattacattaaacgagttatttttaatcattgttcataaatcacagcaagggtacgccctgaggcacaaaacatttgcataaaaatattaattgccactatctctcctttggggttcgtgggaaattaatgtgcaggcagccagtggcaggcacgagggcggatagaggacaggatgaaggaaatggcctccctcaggctttatgtcctcccctgagaagtctccatcagttcacaatgtgccactcagaacttcaggattctcctcagatgtctcctcctacatggagcctgcctggatttctcctgtgtcacctgtgcgccatgactgaacccctcttaggaaacttgaacatccttccgatttcacacatctgcggacgtgtccccacgtggactgggaggccgctgcctgtggttcctgccagagcacagagtgaccagcagaagaatgaggtggggctgccctctgtctcctgcacaggcttcccccacagtctgtgcttcctgaatacaggcgcacatgatgttctctctgaatttacccttttaattaaaaacaggagtcattagaccatgagctgagcccaagtccccgattccaaaacagaaagcagactgttgtgttctgcttctataaaccaccattgcagcctgcatctctcccactgcattgctcaccaagagcaaggcacgcattaggaagcatggcaacgtgtctacccaggccaggaattctgtaaaccagagccttaatctccaaagcaggcctcacagcaggaggtgagcagtgggcaagtgaagcttcatctgtgttcatggctgctcctctccccatcactcacattaccgccagagctccaccttctcttaggttagtggcggcattggattctcagaggagcgtggatcctattgtgaactgcacatgccagagatctaggctgcatgctctttatgagactctaatgcctgatgatccttcactgtctccaatcacccccagatgggaccagctagttgcaggaaaacaagctcagggctccctctgattctacatgatggtgacttgtataattatttcattacatattacaatataataataatagaaataaaatgcataataaatgtaatgtgcctgaatcatcccaaaaccaccccccctcaccctagtccaaggaaaaaaaaatggttggggactgctgctgcagaccatgtgtccactcaggagtgcagatccagaagagaagggaagggagaaggcaggtggggtttggacggctgtgctggtttatccactctccattgccccatgcccgtggtataaatacccctgctgtggctgaacttgggtgaccatcagggtatcattggccttgtcatcggctctcctgagctcctacacgtgggcttccatgcaccacccggatgagtactggcttcttgtttcttttagttttctttgcttatttatgtgtttttgcaagaggagaggcatagccctgaagtgacatctgttgtgctgcaatcgagattccagtgccaagttaaagacaacttccaaatataagggttgttacatatttagttcagggctagcacaacagcacggcagtttgacccacattacagaaacttttttgtatgtaagtgaaaggtattattgacagtaagtttataagtgactagaagggctttggctagagaagattcacagtattgccatgagatcttgtgaaggaaacagagagtgactgaatttggctgacatcatgaaggtctaaggcagcagataagctgccttcttctgcttccattttgttattttatttgtccattcatttattgattcatgggttgttgtgttcctaccatctaccagtcacggtattaaatctaccagtcatggtattaaatctaccagtcatggtattaaatgctgtgacttggaggtgaaaaccgaggcacaatgatcccttctgccattaagcttgtcatcctggagcttggtctcaccacccaggaacctcctacaatgaaattcccacatttagagcgcctgagttaatggtatgattgtgtgtgcatgtcagtgtggggggggggtaccatgacaactaatgaatcttagaatcactttactggctccatcataaattatcctaaactttctttgttcatattcatattacaaagttagactatgctgcctggcgttggaatctgataaaaatctgattttatgtcagcaaccagcaatcttccccggtggtagattgtccaagctggcctttggtttcttgtgcagtccagactgagaagaaagtcttggcatttctgagactgtagggggttgtttcagcccatctgagcatggtgcacaaaggcggaagcaggctggtcctcaaaggactactctgagaaggagaaagcaaaggctatgggctaaatgtcagggtcagaggaatggctccagccctgcagaaaaaattatgtgtctctagcaacaaccgaaaggaaacaggaaaggaaagaaaaatccctgaacacactccagtctcagagtgggacagggctgagctccactgggcagttccaggtgggggggtgggaacatgatcctgttcctggaaaagttccaacaagacagcaggctatagccagccagctgccttgggcacaacacagagcttcctaaagacctcaggaggtaggaaaatcctagatgctgagagactcactcaggagggggctgagtggacagaggtggatttgaaatctgagaccctggtatcattccaaggcctctggccctcagcctcaagaggaacagagcttactcttccctgataatgtatggacaggaagctgctaatcccctgttcagtgagccacccttctgcccatgggctgaggcagcaactttgtctctagatcaccaggcagggctcccttagatgaagactgaccacagcctgaagccatggccccaattgcgtgggctctgaatgatgttgttcctcagacagatattttaggtagactgagacagcaacttagtgtatttaaaagaaaacaggcttgaaaacggagggggctccgttcaagtcctggctaaaccttgccaactctctgaccttagagaaccaactactatttctgcatgtggacgtcttcattggtagcatagagatgccctgatctctcctgaagggctgaggcagaaatgggaggccaggtatgcctgtatctcaggcacttcacagacagttgaaattaacacatgcaggctagttggctgaatggaacacaaaactcaggccgttttctctggtcttttgatccaaacactttcatatctgaaatacccaaaggaaatgaatattttgcaagcataggagcaataggggggtcaggagttgcctttgaatgctctggaaaagcaaaagcttcctttcctctctttgcttggctgaggagcccagatcaaaggtccccactctccccacagtgctgttctctggggacatcattaccatggacccagccatttgttggtttcagtgcggtggtgtttacacagaacgactttactggctatccctcctcttgtcccaggaaatgtcttttgttttatcaggcagagcaacaaaatcatatgatgaaataatcatcaggataattaacccctttcatcaagagagctaagaacacacatttaaggaccacatattaatagcaataatatttagaactggaaaaaatgattttattgctgcagaaagacctgaggagtaggttggcccctctaattgatgctgagtgtgaatctgcgagttgggcagcacacaaacgttaattagtttgtgctcgggcacacaccagctccagtacactcaagtttcatcccaaattgctgctaccatttcccactttcttcctggtagacattattacatttgtgatgattcaaatagattttctgcaggcattaaatttttagtaaacagacccaaattaacagctatttatgacattttactctagggatcaaatcaaaagcactcatttcatatataaatatctcttcttctctgcttttaatgaacgggtatttttgttgctgctgttgttgttgaaggcaaaattagacacatgcctcacccctccaggctgcctaatcatacgtgctccgtccctccaattgagagaacgttattacctttaggagtgaagacagaagcatgttaattttccataattcagtgaaacaaagcatagatctgaaatctccctctgtggaactcctttctcatctacagtaatgggctgccttttaatgaaaacaattcagcctgttctaatgtcaccatcagggcaacacggacttcactggatcctgatttgggaagacggtcttttcattattcttggtgttgtgcaggcaataaaggaactcgagtgtctatgagtgaccttgctggtggcaacgttgtgtttagtgctaatgaggatggcttcacggtgcaaggatgaaagggctggtggaggggttttggcagccgcgagcatccgtccgcttcccgcactgatgggaggtgctcacagcttatttactgcgtgcaaagatgaaatactgtcatacctgggcaaagctaactgtctgttggcatagagaccaaattttggactccagtaaattttgcagaatcacagatgacaggtcaaactgtgttttttcccctttaatggggagaaattacaagttttcattcacatttcacgaatggacaggcaaatgggcaaggtgtcattgataccatgttgattgagaaatgtcttctagatgaagatggcaaatttaacacactcacttagctctttctcttctcaaaccctcattacaattacgacagaaggatttttcaaaaggcctaagcccacatgacaaagggaacagatgaagacgacacaattttgaaaacgggaaagaaaaggctcagtgaaagtgacttagtacacagtatcttggtttggggcctcatcaaggtgaggcttcaagtacaactagcttattcaaaaggtgaagagaactcccacagggatgcgggaaagtgagacggggaaaggaagtcaccaggaatgggcgcatcttcaagccagttaccaccaggggcaacttgaacccgacctgctggggagagtctggaagccagggtagaacacctaccttccttcattagtagggtgcaagaaaattctgagggaacctttcagaaactaacagtacaaagaaatggagaatagcagaggaataagaagaaggagaaggaggagaggaagaggaagaggaagaagaagaaggaagaaggaagaagaaggaagaagaaggaagaaggagaagaagaaggtctgtccaggacttcacatatcgtcatggttaagcttcaaaaggagagactatccatgtggaagggaggggaaaatagcaaagaaataatttaagaacatttcccagtactgaggtcataagtttccaaattgagttttctcttaacccccacttttcccaccaactactacatttatttttactctgttttgcaacaaagattattatctgtgacctgtctctcattcttttctaaactgacatcaatgaggcatccagtcaccagtaactttcatattgctagaccagcagtcagttctcaggtgccgtgtggtttgctctcacagcagagcttgtatgtgctgtttgcatggcttcccaacctcgccccctcttgctcattttgtcttctccttcccgcctcactgattgctctttctcagcctcctgttctggcacctcctattctctttgagctttaattgttggagtgccccaatattggatgttctgcatgaggtccaaactcaccgtctccatggctctcattcagggcaagatcttgaagcccatccctattttaaggactctatgtctgcagattagaactttcctcctaatcccagactaatctatctagctgtacttgtcacattctctggatgtctgtcatctcagactcaaaatgtacaaaattagatgcctcaccatccccccaaattccacttcacccacagccttcctcatctcagcaatgctacgtctactccttttagttgctcaagccgaacattttgcaatcatcttaagctcctctttttcttttttctttccacctccaatataacaggaaatcccactggctctgccttcaggatgtatttagaatgtaaccagttctctccttcactgctgctgctgtactgagagcatccactttgtctctcgtcggcactgctacgggtcttcccaacaggccttcctgcttctaccctcacacaggctgtccttaactccggagtgacagtaagactgtaaagctgtgttaactcattgtcactactctgctaagaggcctgcttgggtccctctataactcggaagaaaagtcagagcaccccatccccactcctagaagctgataagggcctcatgatctctctgtctcatcatctaccactctccctagctgtcagtctacccctgccactctaattccctgatgtttcttcaacattgccaggaacctgcttacctcagagcctgctgcggactgagttgtcttctccaaaatccatttgtggaggccctcatccccagtgggagagtatttggagatgaagcatttggaggtgattaagcttagatgagctcagagtggagcctcaggatggcatcgatgccctggtaaagagggacactgagacctggccctcccttgctctccaccgtgtgaggacacaatgagatggtggccacctacaagccaggaactgaaccctacggggccttgacactggccgttccagcctccagaatggctaggaataaatgtctgctctttaagtcactgggcggtggagctttgttatggcagcaccaggggctggttgagagcctttgcatggctcttgttccacctggaatgagatttctaactcttggctacctcacccccttacctcattgtttcatgttgcaaccacccacccactccccatgtctctggcattctcatttattttttctttgatttcatagaacacatcacaaagccatttgctcatgcatgatgtttattgtctattttctatctccctgctagagggtaagatgctcaagaacactgctctgtctgcctccctggacccagaaaatgcttggcgtgtggtagaacttagatatatttgtgttgaataaattaattgaaggggtttgcagactattcagtacaatcgattataaaaacccgaaccagccccatcattgctaaactttaatgaggcaagtaggatatcatttttagtgggaaaaatcaggttcattcaaagtgttggggaatccagtgctatcaaacttctcaacagcaaccttgaaagctaggagatagataatgccttcaaatttctagaggaaaatatctctcacgtagcattttcttttctttctttctttcttttttttttttgatggagtctcgctctgtcacccaggctggagtgtagtggtgggatctcggctcactgcaagctctgcctcccaggttcaccccattctcctgcctcagcctccagagtagctgggaccacaggcacccaccactacgcatggctaattttttgtatttttagtagagatgggatttcaccatgttagccaggatggtctcgatctcctgacctcgtgatccgccctcctcggcctcccaaagtgctgggattacaggcgtgagccaccgcacctggcctcacatagcattttctactcagcccaactttcattcacataggagggaagaataaaggcattttcttacatgcagactctaagcagatattactcatttgccttttttggggacagtcctgtagcatgtgattcaacaaaacacatccataaaccaagtagctccaagaaacagtgactacacccaggaaggaaaggaagaggctgtccaggatggtgatgatgaacatccaagaaagcaattatcagacaaagggacatacattgacaggggcgtgtgcatcggcaggggagttgcaggatataccagtcctaagcacattaaaatctcaaaaaaaaaaaaaatatatttcaacaagatgattatccctgaagaaaacaaagttcattaaaggagatgtaattatagtgcattaaacgttctagccaagagcactatttacataatgatgatgatataaatatgtaatcatcatccaccacaactatgttggggaaaggtgaagccagtgtgagtgtgtgaatgcctgtgagagaatgtgagtgaatgtgtgtgtgctagtgtgtcaagtgtgtgccattgtgtatgagtgtgtgtgaatgtgtgtgagagtgtgtgtatgggagtgtgcatgtgatgagccacatccataagctgaatcatcttcaaaagatgagacctaaacctaacaattcaagtaacaggatgaaagtatgtgacttgaaaatatggagttaaatatcaaaaaaaggtccttgcatctgggaagcaagaatcaaaggtggatgagaaggggcacaaactgctgttttaaattttaagcactgtagcatccttgtttttaaacaaccatttacatgtatacgtgtgtgtgtgtgtgtgtgtgtgtgtgtgtgtgtgtgtgtgtatcttagacaaaattaagactttttttctgctttgtttccccccccccagcttttctcaagagatccacaatccggagggaagacccacaggcttcccagcattcacacagcatcattccctttgcctccagtccctcctgatagtgcatgaccccactggccgtccggatggataggcctgggactctgttattccaaacccacccaacctcacacatcctttccctacatctctgcatgtctcattctttcttgtctttcaaattcagggcacacctccgtctgctccctcatagaaaggccatctctctctctgtctcttaacctctctctctctctcaacctctctctctctttctctctctgtcttccttaaactgttattgtgcttgctccatgtcttctatggtctttgccattttctaattgcagttataaccatttgtggctgtgtcttattcactcctcgttaagttcttcaaagtcagtttgaaattctagaatatactacatggaggaacactattctattagtactttttaagacccactcttttttaatgtctcttttttaaaacttttattctcattataatatatccttatctctgttttgtttgggattattcttctgtacctcttataactacttaactgggcacttagatcattagtgtataggctccttatttccagattgtaggtttgaagcttaaatttttctctcaaaactgctttttctagattatgttaatatttggtgtagtatttttatcatttactttgaaatgttttaatttccctgatgagttcttattgacttgtagctattattaatacacatattttaaaatgtgtgaatattgttacaaacttaaaatattaatgtgctttgaaaaatgatcctcgtgatagcatctcactgcgatttcccagacctagcacatggcctaccttggtctatgccccacatgagtttgttttctctaataagtgggtacattgatctggtaaatgaatcacactttaattgcatttttatatatatatatttttattatactttaagttctagggtacattatttcaacagttgatactttctttatttggtttgttgacaatcgagagaagaatgttaaaaactcacactttgattatatatatattaatttctccctgtagttttgaaattttttgctctatcaattttaggtgtgttttattaagtgcaaatgagcttagaaatgtgatatcattatcataagtaataacttcaatcattttgtataaattgttatccttgacaattattttgactcaatatagacatactttctgcatttttgtagagctatctcctcttctttttggttcctattgcctgctgtgttttttcccatctgttttgttaatagttatctaaagctgcataacagatatcctaaaattatgtggctttagaacaacctaccccttgttgtcctacagtttctttgggttaggaatctgggagtggcttagttgggtacctctggttagcagtgtcttacgaggctgaactgaaagtagtggatgtggctgtggtctcatctgaaggcatgactgaaggaggacttggttccaaactcactcacctggttgctgaaagaactcagcatcttacaagctgctcactagggacttctctcagatcattgacccatgggattcttttcagaacagcttataaaatggcatctggcttcaatcagatgaacactgaggaagcagagagtgagcaagctgggaacctaatctcagaagcagcatccctccaactttgctgtattctgtgcactaaaatcaagtctctaggaccagcccacaaacaaggagaggagagtgtgaagattgtggggaccattggaagtcccctgagatgttgcctacacacagtctcttcactctcaaactttccatctctgtatatttttggcaggtctcttatattcatatccaaactatgacatctgtctgttaaccttttctttttttttttttgagatagggtctcactctgccaccaaggctagagcacagtagtgcaatcatgagtcactgcagcctccacctcctgctcaagcaattctcccacctcagtctcacaaaatattgggattacaggcatgagccactgtgcccagcctctattaacttttgagttttatgatttttcatttattttcattactgaaaactttgaatttttaccttattctatatacaaatatataaaataatatttataaataacacac

SEQ ID NO: 740 - DNA, 2585 bp, Homo sapiens
agctgacacagatggtgggaggtgctcgtgcctctcacggtgatcagaaacatcaccgttgcaggtgacgccacttcacttaacactgggtgtgggcggattcatccgctctgaaaattacgtctttggtggacatcagcgtggacttgggttgtcttttcactttcttgctaatgtccttggatgatccacaacttttccaaagcaggccaagctataaataaagggtggactgaccttgtcaactgttaaattggagccgtggtgcgttgcctagaacattgcggatgaccccgagcagcacagcagatcaacggctgagaaagagctcattcagctcatctaactaggatgctgtcctgccagagccctgggggttctcgtctcctggggcaaaagcagcatgcaacccttatgaacccatcttggaaggcattcggggagcccaagacaagaccattgggagcctcagggtcacttgtgggggtctctgtgctggacggctgtacctctcatgaaatggacaactgaccataagaaggaggttagcctttgtggcttgggcatccagcctttcagagatatgaaaccacacacgtcttcagagtgaacagctgctcaccccgatgtgctcaaggggtgcaggatgtggacacatcctactgaatgagccagacaacgtaactggatctgtccagaacaccacgatgggtgacattgccatctgcagcagtgctgtacttcctcccgccaatttgtaaagtgcagacaggatgctggatcaactggctgctgctgaggccagtgacctctagggcgtattcccacgttcctttgcagtagctgctcacctttgtaagcatgtgagttattcgtgctgtctgttgtgatcctaaggaatccaatggtcaggaccagaacttctgaagtacagcccagcattgccgtctggcatccccagaaagcagattttgagattggcatgatggccgttaagcagggcgttctctctggagcaatgtctagccggggtcggagtggggagagagagaggggggctgctgagaatatcacagagagatggcagcctttctgcagcataggcctaagtgcacactcacctggctatcactgagaggactctctgttcaacagggccactcagggcttcccctgcatggagatctgagtgtccagggaggggacgtggtgagcatttctctggtcaaagtgtgcaaagcaaaatctgccccattcctgccaaagtggttgacatggaggaaaggggagtgccagttctgtaggctgaggtggtggctgttagaactgctcctaggctagttggtgttctggaaggttcccctctatgtgagatgaaagagcatatctttaagagctgcaactttgaagctctaatatagaatgcttttggtggcaagcattacttcggaaagggcttgaagacccctgaagatccttggtggcctaggcagttcctttattgccagggctgtgcaggactaagcttcaacagcgccaccatgtgacaagaagcaattgcagtggtgcattgagggttttcttttgcactgagaactcaagtcccactttcacccttggacctggtaaatctttggggttcatggacaattctgaggaggagatacttaagagagtgatgttagaatttgatgttttggtttattgtatcagaaaataaaagaaattggatttatagctcagtttgtggttcatatcaatttaaatagctttgaaatgctgataggaccatcacggttttttggttgctgaaatcccataactaaagcaatgcctcaataagcttttaatccacagcccccatgcccaggtctataacaaagtttttatatgcctatggggaaaaacaattatgaggcaaacatttataaagttaaatttattacgtttctactcctattttttattctgctggtgtattgttatatattttcctacatatttaaacattttcttcctcttataaaatgttagtgattttaaatgatggtgtgtccggaattggttccttctggtgggttcagtcttgctgacttcaagaatgaagccacagatgctcacagtgagtgttacagctcttaaagatggtgtgtccaaagtttgttccctcagatgttcagatgtctccagagtttcttccttctggtgggttcgtggtcttgctgacttcaggagtgaagccgcagacctttgcagtgagtgttacagctcttaaaggtggtgcgtccagagttgtttcttcctcccagtgggattatggtctcgtgcagaccttgcattgagtgttacagctcttaaagggggcacggacctgaccatcctggctaaaatacagtgaaaccccatctccactaaaattacaaatattagcccggagtggtggcaggtgcccatagtcccagctactccggaggctgagacaggagaatagtgtgaacccgggacgcggagcttgtagtgaacagagattgcgtcactgcactccagcctgggcgacagagcgagactccatctcaaaaaacaag

SEQ ID NO: 741 - DNA, 2028 bp, Homo sapiens
cactcaggaggctgagacaggaggatcgcttgagcctgggagttcaaggttatagtgagctatgatggcaccactgtactccagcctgggcaacagagcaagaccctgtctcaggaaaaaaaaaaaagcagactgtaggccagatatgagaatggacggtttctcaatttttacctctactgagcactgaatgaatgaatagagagtaggacgatgggactgttaatattttcagcatttccctctcattcttttcctctgggagatagtacatacaatggttaagacacaggctatagaatagactgacttgggttcaaattcagctccatgactgactttggagtgtgacctctctgaacctcagtatcttcagctataagacaggagtaattgctacctcactaggccaggtgtggtggctcacacctataatcccagtacttggggaggccgaggcagatggactgcttgagcccaagagttcaaaacaagcctgggcaacaaggcaaaaccctgtccctacaaaaaatacaaaaaaaaattatccaggcatggtggagtgtgactgtagtcccagctacttggggagctgaggtgagaggatcacttgggcctggaaagtcaaggctgcagtgagccctgttcaccattgcactccacccaaaaaaaaagaacaaccttgctgttatgcggattagacaagagacaccatatgatactgggcatatggcaatgctcagtgaatattggacagctaatacaatttgcagagtcactgaggaaaagtatagcttcagagagcttctgtgtccagatttcaacgattttctttcatcattatttcgtggggctcccaggaccatatgtggctcacaaaccacaggctaggatgtgtttaacgttaaaagcaagcagtgtgtttctctgaagtgtggctccaccatggtgttcggttacacccagaggaggaggctggtgggcagtcatagaagtgcatcttccagagcaggaagggatcaacagctcttcctggagacttccattctcctaccccagtttctgagcacagcatgaatctagaggagtttctcttctgcttttcctcctagttttgtttcctctatcccttttccttgctaaagtgtgttggatggtcaggaatgtgggcggagaagagggggagctggagacatctcatcctttcatccagcttgtgtaaaaatgcctcagaactccctcataccacatgcaccataaattataaggtcaagctttgtaagcctgcagccctcttggctttttgcatgttggttagaatgcctaaatagaaagcctctgttaatgttgattgcctcttgtctgttccaggttggcaaggcccccagtggccaaggcatgagcctggatgccctgcaaattgagtacgtgttagggatgggggccattctttatagtttgactctggagagctaggaccacctttcccagcctcaggggtgcacatcctcaggagctgcctacctccagatattgtaagtccatgcagaagaggaagggcccagctggggcacctcttggttgaggaatgagtatgtgacattttcatgtgggcacattttgatactactttaaaaatagaccaagcacagtggctcacacctgtaattccagcacttcgggacgctgagagaggtggatcacctgaggtcaggagttcgagatcagcctggccaacatggagaaaccccgcctctactaaaaatacaaaacattagctgggtgtggtggcacacacctgtaattccagctactcgggaggcagaagcaggagaatcgcttgaatccaggaggcggaggttgcagtaagccgagatcacgccactacactccagcttacactggacatgatgaggaggaggaggatgatggtggtgattatgatagaaatggtgatggtgatgatgacaatggtgatagtagggatggtcttgctctgtcgcaatcaataaatgaatgcataaacac

SEQ ID NO: 742 - DNA, 1571 bp, Homo sapiens
aaaggaaactgaagaaggtcaatctagaatgatacttgctggatggattgaaaaagtgaagctttagcagcaagtagaaaaactgaagcatcagttgcagtaactcatccattgagtgaaaaggttcttcccatgtccctactctcagaaatgcattctgaaatttcgaagaaacaagacattacacaagtacatggcttcactaccaaggggaagggcaaaagaccatctttgatttaattccaggcttcagtgtctaattctgtggcaaagatagctcatgaattctttgttcctctgccaagcgcaacagggataagtagccttgctctgggaatatgagtttgatgattgggttgcatgaaccctggaagcctggaatattcatctattttcacattcttctgtccctcctgactgcagcactccccaaacctacatggaagagctaaaatcaattctggtaaatctcatcaacttctaggacactgtggtagatttccttcagtttaatctctagcattaactggaagaaacattttcttactcagtcactacatttgtcaagaaataatgctatggttgaacactgcacgaaatgatagagattaacagtagcacaatactagacatttcttttttgctattctacttaatgcctgatgtaacctcatgaggtggatgttgtactcctgactttagagataagaaaactgaacttttgggaggctaaataacttacttacagttacatagtcaagaaatggagatggcaagagttcaggcctaggtttgtctgattgcaaatactacatcctttctattgcttcactttgtttggctttaaagctgttaaatgagaatgaccataataccccagagaacttctgtgaggattaaatggatatgcaaaagctctcgacataatacctggctcaagacatctggggaggcattcaactgggacctgcaggattcgctttcaatgtggctcacccacatggccaggagtgcagaccaggaccagctgtttctctccacatgggtttcttcaaggacttcttgggcttcttcagagcatgccagctggatttcgtgagtaagcatcttaagagacaaaaaatggaggctgccagtttaataaagcctgtgccagaaactggtacagcatcacttcctccatactctttcagtcaagcagtcatagggcccagattcaaggagaaacgcataatccctaccttttgatagaaacaattttcacttgaaaactttgggggtatgttttaaaagtattacatctcccaaacctcctggcagtcaatgccagagccaggatttaactgcaggtttatttgatgacaaagcccattttacaaagactaaaacagacctgaagagaaatatagcaggtttaagtaatttcccatggggaaatgaaaactctgaatccaaagtccttaaattagctactacactatggttcacaagatgaaatgcactggtgcatggcagtgcatttttaaattgtgatgctttctatcaataaactctttgtaagtaaaagtaaa

SEQ ID NO: 743 - DNA, 11863 bp, Homo sapiens
cactgggttagaggacatggggcagaagacctgagaaggaagagaggacagttctgtgccacactggtcatatttagaagacattttcatattccaaccattgttctgtgtgtgcattttatttctcacgactgtatatgtagttaacaatactattttttagggaggtgggggggtcagccccccgcctggccagccgccccgtccgggagggaggtgggggggtcagccccccgcccggccagccgccccgtctgggaggtgaggggcgcctctgcccggccgcccctactgggaagtgaggagcccctctgccaggccagccgccccgtccgggagggaggtgggggggtcagccccccgcccggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccgaccagccgccccatccgggagggaggtgggggggtcagccccccgcccggccagccgccctgtccgggagggaggtgggggtgtcagccccacgcccggccagccgcctcgtccgggagggaggtgggggggtcagccccccgcccggccagccgccccgtccgggagggaggtggggggggtcagcccccctgcccggccagtggccccgtccgggaggtgaggggcgcctctgcccggctgcccctactgggaagtgaggagcccctctgcccggccagccgcccgtccgggagggagagtggggggtcagcccccccccgcccggccagccgccctgtccgggaggtgaggggcgcctctgcccagccaccacccggtctgggaggtgtgcccaacagctcattgagaacgggccaggatgacaatggcggccttgtggaatagaaaggcgggaaaggcggggaaaagattgagaaatcggatggttgccgtgtctgtgtagaaagaagtagacatgggagacttttcattttgttctgcactaagaaaaattcctctgtcttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcgccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaacaatactattttttgaactatctaccctttctagatgttctgaaatgcctatgttaaaattagagatagtaaaataacacattttgtaaatctttttgttaaaattcatatgtaatgttgttttggttggggggggtggccaaaccacctgttaataatacacattgtgtttgtgcactggttcaggggaggagagaggaaaggaagtgtaagagctctatgccaatgtgcttatagtgaggcaaggttaaccattgtctcatgcctgggcattttgttttacttatctgggtatattgtggatctaaaggacaaatgagtcctgactttacatctagtctttctagatgttaaagaggttgctagtgtatgacaaaagtagttagtaaactaatatattttgtacatttcgttttaagattcccaggaaagacagtcttctgaaaatttgagcattattgcccagtgggttgatggagatgggaaggtgtaggccagaatgttcatacttggaagactcagtcataactgtttttacatgtgttcactttattcaagacttctgtgcatatagtggacgaattaacttcttacctgaaacatcttatctatgtagatgttcagaattgcctgatgtatgttaagtgtagaggtagtaaaatatcaccttgtaaatatctttttgctaaaattcttgggaagtactgtcttttggaagtggaattgtgaagccacctctgtaagcagtatagtactgtctatacttgttcaatggtttagaaatgggagggaagaaattgccaaaggtaatatgctagtgtgttcatacttggacatttcacttgccatttttctgtctgttttgtgcattttgttttgctgtgtatgtagagtacataatggacaaatgagtcctaattttgcaacatttggtctctagatgtttaagaagttgccagtgtatgacaaagtatctagtaaaattagcacattttgcacactttgtattgaaattcataggaaagcttgtcttctgtaaatgatttttgggtatgaatttgttcagccatctctaagcgttacacatgcctgtacctgtccactggattgaagacagagagaagggagtgaggaaggactggttcaaggtcaaaattgtcatatttagaagatacctccgattatagccactgatacatgtgcaattttattttacagtgctatgtacacagtggaaagttatatgaaatatctggtctctctagatagttagaaatgcttgatgtatttaaaagtagaaatagtataataacactttttgtaaatagcttttaaaaactgatgggaaatactgtgtttgcaagtgggattgttaaatcacctctgtgaacagtgttacttgttcattcagttgaggaaggtgagagggaagaaattacaaaagatgttttgctattgtgtactagaaaatttcagtttatccattgccttatatgttaaatgcattgcaagtaactttgctatactacatattgtgttatatactggaaaaatgagtcctaattttaaaatatccactctctagatactaaagaggttgccaatgtatgacaaaaatagtaaagtaacacattttgtacactttgtgttaacgtttataaaaagactatcttctgaaaacgacttttggaagtgaaatgataacatcaaccctaagtgacacatgggcccatatccaccaggttggtggtgcagaggagctggaagaaatgaaggattctagatcagaatattcctatttagaagacagtttaagataaaccatgtgtgtagtttattcaaccctactgatgcaagagaatagggtctggaggcaggaaacataaagcagattcatgcagacttcctagaaataaatgaaatggaaacacatcagctatgacaggacatatactctccaacagagtaaatgactttgtaactttatttcatcctctccatttacatagggcgtacatcaagtaaatgactagggtgtatactaagtaaatgactttgtaactttatttcatcctcttcatttacataaggcatataccaagtaaccaatggaaaccttgagagggtatttaaacccgagaaaattctgtaactgggctcttgagcccctaagcacaggccttctcccaccctgtggagcgtactttcatttcataaatctctgcttttgttgtttcattctttccttgctttgtgtgttttgtccaattcttggttcaatatgcccagaacctggacaccctccactggtaacatattttggcaaggcagccaggaggtaagcccaaagtttgggatttttcatcttttcttttccactccatacaggggaatctctccctctgtctctttttcctttccaactcgggacccttggtgggcagcgcctaaacacggaggcaaccgcaggtttctgggtggggccatcctgaaggacttttttctatcttttctggttgtggtccctgattcctatgtgtggcgcagctcagggcaaacttgcagctcagggtgaacttgcatgtgtttcaggcgacggaaaccctacttgactggctaaggacaaaagaagcctactcagcttccatttcctatcattacagttcatggctatcatgctagtggaacaggaagcatgggataatgtggccttatcaaattataaggatgctaaacgccagtgattacacccaggaaccaaaggacagctcacaattgcctctggagggaaaatatgcaaagcggcactggtgcccacgtaaggtcagagatgcctgacactcttaagactggaccccaaagggggattccccaggggatcctccagacttcaacctctccaaaggggatgcccttggcagcagttctaaggactagtactaagccctccttagaattttctcttgcagttgcaatactgtttggccccaatatggtttggattctggcatttgctgttgaatgggaaagcgggatgcagttgcatgtatccaggctttggtgctgctgttctaagcaggggcaggcctagttattatgtgatgttctcctttggtgctgtttgaccccagtgttctttcgagtctggggaggtttggcctttaaaaatcaaactgccatggaaattgctttacctgaaataatagttcacagccttcattggattgcttattgggtacacaaagtaaaattggcaagcttgtattgctatctcatggttagggttccaaggtaaaagctattgaatcttcatttgtgtgtgtgtatacacatgtctagatgtgtttatttgcacatttgttatatgttgtgttttggcatataagtaaaagagcactcataaattaagtaaataagtcgaagcaattttcaagttcacatgacttaagtataactttcctaaacaggctagttttaaaattattggtgaagtaaaaatagaaatgccttcagaattgtcagcatatatttttgtctgggttttatatttgtctctgctagatattttgaggtgttagggtttggcatagaaggttataaaactataaacccagccaaaacaaaacgatctcgtttgcgtttttttttttttttttttttttttttttgacaaatgagcataatttaatgttagctaaatcttctgggttactggcaaaaatacgtatgtattaactttgaggctcttacttaggtttaagtgcacacctggctattcaaaatgtggttaacagggaaataactgactttaaaagatagtgtctaacatttcggtttacagaggtaatctagataaactgttaaaagtgaaacaattgagtacagtgaatgggacaaatgttttagataagctttttgtgtaaagtcttaaaatcatttttgatgctcatttaagatctgggccatttccaattagaaaggttgtgatatggggaaatatgtttctaaaattgtggaattgttcttaactataaattcccatatctgatagttcaggatttctagctttttagcgtttcactaaagttttaggttactaaggataagaattctagttaacacataattctgtatacaaaacatgccagaaagtttgtgttattagtgagaaaaagaataatttagaagttatctaaaagttagttcaaattacagatttgaaaaggttacttatgaaacaatgtagtaaggaaccagtaagtagaggagaacgatatggaaaaagtttagataataaaatattctttaaaacctgatagagaattggagatatttggctaattaacattttcatagtgaaagctgttagtcttgataaaagtaaaataagcattgtaaagaaatgcatcggcagtttggcaattcctttttactatagttaagcatgaagccggatttggtgtggagccaaatttcacatacatgcttgcattgcttcacactgtttactgttttgtgtggatagtgctggcactggagtacttattggttatgtgcctatagtgtatttcttgattgcacaggatgtatggtgatattggtgaacttaaggatactgaattgtgtatcaggaacaaaatattcattatgtgggttttggggggccctaggtaaacactgtagcctccagggtagattgagaaggaaaaatttagggttgggttcctatttgtttttgcttctaattttcatttgtttgccatttattctcctctggctttgcttgtgtatgcacatataaaatcatatatattttttttaaatttctagtggaaggcttttatttggttctgtgaatagttattttgttccctatgcatttctagcaagtcatcatttgttccatttatctggaattcctaggctacctttgtcaggctggcaggaattgatggagcacaccagctttttaaccttgaactaactcaaattctgtttatgatactttaagtgtgttgagtatattttcataaacagaatttgagtcatatttctctgtctgcccattttctccaaaattcgtaaactatttgtgaatattcttaattcatggcaatgtgtttgtttgcatatagtcaagcagggttcctagggctgctttgggagacagaacccagaaacctggcatactggcaaaagggtaagaatttcttaccagccagactctggtctctgtctctctgtgcaaactgcataaatgaatagtaaaagtcactgtttatctcctctgtaaagttttgattaatataaaaaaagaattctgaggccgatcttaagctgtagtgaatctggtgtgctttgtgtctttctgtattgttttgtcataaagaggggtaccttagaataaaatgtgtgcttaggaccccatagacctgctgttcaagacacaccagcagactggtcagtcatgtctttgggagcttgaccttgtaaccatgtggccatgctttctcttttcacagtggcagcctgggtttagggttcaattcctggcttagggaatgagtcctttatcttctgtctgtgtatttatatgtgttgtgtgtgtactataaaagagcattaattaattagcttaataataataagagcttaaatcaaatattttatcagaaaagtaaaaaatgtaatgccttctatttacttcatgtaacttaagtaatctttgggaaataaagacagttttaaagattattggtaaaataaaaatatcttcaaaatgtaaatatttagtctaaattatgcaggtcagatattagatttgcaaaatgctttaaggtcataaaccgcttctttgacttttaaaaattgctcaatttattttggagcattagattctagataaggcctggggacaaatagaattagccatgtcccctagctatgcaaagaaggttataaagaaaggagattttatataagaaaggatcttatatcgtaaattcgtgtcctaaagtaaaataagcggttgttaaaaaagagggatgtttaggacaagttagaaagtcaaagcatgtcgtagatggtctgtgtaagtcatgaaataatttacaaaagagaatttatgcaagaaatatacaatttaacggtgattagacctcctaaatgcttcataaaatgccactatgactcttaactctacaacttgcctgctttacagctcggtaaggcctgagacacgtggagtcagatgctggagtcagaccttaagtgtacttctctctgggtcctagactccacaactaatatataattaaaatccttaacttaccaaagttttcaccaaaagtaaaactcgctaagagttaacattgtaacatgtaagtgagactactgaagcaacagttttacatgcaagttacgtaagaaaagtgaatgcattttcagtgaaagattataacaaggcatgggaatgtagatttttttttctgtctaaagggttaaaggattgttttaagttaggataaagctaaaagtttgaatgagttgtggaagatttataaaaattaatattgtaaaaaattatgtgtgtgaacatattgactaaatttaaaggggtattttctggtttttccataaattgaacatcaaaataaaagcacaaacagggttttcttaaagcaccgatctgctctttaacaaacatttgtaaaggattataaaaggtttatgagaatctcaccttatggtcaaacggattaagattggaaagatatgtctacaaggttttcttaaaaattggggttgacattaatagcacactaatgcaagggtgaaatttggctttctctcttgaacaagattttcatgcagtattaaaagataatgaaagatctttgtttgccttttgaataaactacccccccaccaaaaaaaaggaagggaaagacaagagacagattgtttgtaaagtaagtcttccatctatcaacatggaaaggtttttgccttttaaaacatttttgagtcatcattttgctaaatgaatgactatggtaacctggaattccatttcataatgtcaagtgttttaaatctttaacatatttaataggcttcccaaaatcaaatttcagcttcaaaattgtcttttctaacctctaactttgagatgctgcagagggcccctgaagcatccaaaagagaggtaaacagaattatttgacatgtttaattacatgggaagcattgtcaaaaagaaaaaaatttaatcttcttcaggttatattttagtgaataatattaatatatgttccaaaattgtatgagatttctaaaattccaatatgtctgagtatatgctatcaatcataattatgattattatgttattgtagaccacagaaataaccaaatttccttgtcaattgtgtttttaactataactatttaaagtcatttccacagttaattgcttaatgctgatgcagtttctgaaaacttcacaagcatgcaaagtcctagaatatggtgtcttttaggagattcatgaaagattggaaaggaccctaaaaagcactcttgaatacaggtttctaataagtttagaattatatcatttgaactgggtaagaattcctggaactttaatgaaaagactgactgagttctaaaactgctaacccaagtagaacaaaaattaattaaataccaagaaaatactttgccagattttcatgctaaatcagctgatactgaaactgtttagatataaaatttgaataaactccatcatttaaatcaaattacctatgataacccatcagttatcagtgttatgcacctaatttggggaaacaactggtattcaagaggatatgagtctaatgttaattaagcatgaactcatggagaaccaggatggccaccttgtccttcctaagtcgttaaagcttttgttagtaaaatttctgcattacatgactcgtcacggaaaagataaaatgatccaaattgaatatattgatgtggtgacttataaattgctaaaatagtttataaccaatgtttggtcccatattcctgggaaaacaatcaaagcttcaggtacatccagtcacctgataggccatttaaacattttatagagggattttattcaattgttattttcagtgcatgttttctggttgtataaaagctttcccatgcaagagggctgatgttataacactaagttattatgccaccaagtattttcacaaggtaaagaaagctttttatggttcactgaggacaatcaactccttcacaacctagaaactgaagattgtatcttctgaaaacattggataaagactgtccttgccatccacactacagcaaaacttctggactttgaactttgggttcatgatctcacaactgagaagagtccctccacactcttggaactgtacacccattggaacccttaaggtaaagctaaccagggaagtttctctcccgaagaagatggcatccttgatgtgaacagcttttcccaagatcatgaatcaagacttctctattatcatgagactcttatctttgaatattttttccttgcttttgcctctatgaagaatagaagtggaaaaaggatctgttgtgtacaattatgggttatacttttatttgtgaagaattttgcagccagctttaggtcctttttccatgatttggaataaaagaggcaaatgtatccctcataataggctccatagcagtttactgtaaaggctatggttacataatagactaaattatcttaagaaagttatgctaaataatagagttggctaaacagaagagtatctgtgcagctgctggcactcatggcctatggagaaaacatcaggtattatagagattcagttgtagcaaattaatgaagagactgcttagttaagtgagtagactctttagctcattgtttaatctatttgagtttaggaggtttggtttatggtgaccctggataaggagcatacttactctcaactcttggtattatcctcctgatagtcataataatagtctccctggtgtgctgtattctctcaacggttttaaatgtttgcatgctgccacctctagaatgtcaaatggcctctcttcaactggaatgacaagagctgaaagaaattgcagccatgaggacactgtaacctacgaatgatgtgctgagtccaaaagcccaaagtgttggtaactgagagtggtgctaagtaaggccctaagttttggtcacactctcacttaagtgagaacctgaccaaaaaagtggaatttttttttttttttttttttttgagatggagtctcactctgtcacccgggctggagtgcagtggcacgatctcggctcactgcaagctccacttcccgggttcacgccatttttctgtctcagcctcccgagtagctgggactacaggcacctgccaccacgcccggctaatttttttgtatttttagtggagacggggtttcaccatgttagccaggatggtctcgatctcctaacctcatgatctgcccacctcggcctcccaaagtgctgggataacaggcgtgagccactgcacctggccaaaaaggggaattttttttaaacaaaattatgggaggtcatttttttgtactgagcccatgcgccaggccccaacagaccaaactaaaccaaaacggagtcacgtatgccaagaccttaaggaaacacatagatcctagaacagaccacaggccaggttttgtttttctcctacaaatctctataacaaacattcctgacagcatagatatccaccccctgagttcccattaaatcttttaaccaaattaatttcctctcgccaaaagaccatcaagcttcagatgatcatgcaacaaaagtttcatccagttccaccacccctggccatcaaggagctaccctgccttcactagaaagagcagagcaggacttctgtgatcctcaataggtagggactaggcctcaagccaacatgaagcagttacaaaagaaagaccatcggcccctccacctcccataaagatttatggggatcccatctctggagggaaatgaggcagaagaatagggtctgtaggcaaggaatataaggcagatgcatgctcacttcctagaactaaatcaaatggaaacacttcagctatgatgggaaatgtcttctgtatttacatagggcatacactgagtaaccaatggaaacctctagagggtatttaaaccccagaaaattctgtaaccgggctattgagcccctatgctcaagccctctgccaccctgtggagtgtacttttgttttcaataaacctctgcttttgttgcttc

SEQ ID NO: 744 - DNA, 3893 bp, Homo sapiens
cttggaagcagtgggaccgtctggtggtagatgcttcacttcttcatttatgactccacattcgtggaagagagcaaagaacaaacctatttctgaaatgtttctggcttccatatgcctctggcttttaggaaagcacaagtggcctgcttggggtccctcctggcttgctggacttcccgtcactttttgcctgtcgtcttccatggttcctgcatggatcttgttgcctcaggaccaagctgcctttgcttttccacaatgtccatgactatgtggggaaggaaatggaccctcatgctgacagcgcatgtccacgttactagtttcctttagaaaaccatctccaatgggccaggcacggtggctcatgactgtaatcccagcactttgggaggccaaggctggcagatcacaaggtcatgaaatcgagaccagcctgaccaacatggtgaaaccccatctctactaataatacaagaattagctgggcatggtggcacgcacctgtaatcccagctactcaggaggctgaggcaggagaattgcttgaacccgggaggtggaggttgcagtgagccgagattgcgccactgcactccagcctggttagggagcgagactggtctcagaaaaaaaaaaaaaaaagaaagaaaaccatctccaaccttaactccaggggcgccattcataccctgttctatagaacctgcccaaggtgtgctcctgaagaaagggaaggtgctgacctaatggctccgagaacagtatttttgataaagtgcagtctctcagcaagtgtcctcaaagtgctggccttgctcatgcagtagagctgggaaagcttatttgggacttgggtaccacataagaaataaagagggaatgtcatactagcaggacttttgacaaaaaaagcctggtatgagaggccctgacactaatatgattcctattctcactcaagttaatagatcatttaaccaatagcaaaaagaaccggaagtgtcctcccaaagagtacactatggaaagggtggggggatggagtacctttacagtggagaaaagtacccttacaccacctctgcaggggatctaggtcaacatcagcagttacaagttacattgacagcatgtggccttgatatgatgtgatgagaatggctcttcacccctgtggtcttcctccacaaaacccatagccccagttaaatcatgaaaaaagcatcagacagaccccaattgtgaccagcactcctcaaaattatcagggtcctcaaaaaaaggaaagtctgagaaactgtcacagtcaagaggagcctcaggagacaatgaaaactaagtgtcatgtggaagtttgaacagaatcctggaacagaaaatggacatcaggtaaaaactaagaaaatctagatagtgtggacttcagtgaataacaatgtgttgatattgattcattaattgtgacaaatccactacgctaattgccttagtctgttcaggctgcaataacaaaataccatggactgagtggcttatacacaacagaaatttatttctcacagttctggatgctgggaagtctaagaccaaggcactgccagatttggtgtctggtgaaggtccatctcctggtccaaacatggctccttctcactgtgtcttcccatggtggaagggacaagaatttctaattccactcatgagtgctctgatcccaagacctaatcacctaccaaagcccccaccttctgatagcattaccttggggcttaggatttgaacatatgaactggggaggactctggggaaacacatttaaaccacagcactaatgtaggatgttaataataaaggaaactgggtgtggggtttatggaaactctcttaacttggtatgaggtatatgcaaactctctttaatatcttcagaattttcctgtaaactttaactttaatctgaacttctaaaaattatagttatacacgcatacacagagagagagagagagagagcgagagagagagagagagagagagagaagttatacatagccttcgtgttgcaggtctagcctacacttctagccttattccccctgtttaaaccttataagtcagccaatataatgaaatttccttaaggtcaagatgctactatgtttattctccaaaaaatttgaaaaataaatgagttttcttaatttcttagaagactcaataaagttgagatcataaagtgtaagttaaggaagaattctacctgaagagactcatgaaacaaaaatgatggtgaggaaagggagtgctgtttcattgactagaaaagaattagcaaattaatcagcacattgccttttaaatgttccacttcaagagatgcacacattttcaggcccaatggtatcgtcacttccaataaagctttattggtggtatctggagaacgctatcctattatatccttggctaagctcacatatgagagactctttaaaggaacaatgcaatagtcttgatattcattgcagacactggttcttgcctactcaataattattccctcaccttcctgacaaagaacccgacttgttcaggtatctcacaatgtgctcaggaaaggtgggctcttccccaggtccatgtggttaaccagaactgctctaaaacatcgtgagaatcccattcacctttgccagtgattggtttaagggtagggagattacccaattctgaacaatgatataggagaagaaagaaatttactaggggattgatgggaacaggttattttgttcactatacagggacacatagtgagaggtgacaatgtgctagcagccctcactcactctcagcacctcctcaagtgtgggcgtgtggcgtgggactggcaggcagctctgcccatggccccgatgtgggatccactaggcgaagccagctgggctcctgagtcaggtggggacttggagaacttttatgtctagctaaaggtttgtaaatgcaccaattagcactttgtgtctagctcaaggtttgtaaatgcaccaatcagcaccctgtgtctagctcaaggtttgtaaatgcaccaatcagtgctctgtgtctagctaatctagtggggacttggagaacttttacatctagctagaggattgtaaatacaccaatcagcactctgtgtctagttcagggattgtaaatgcaccaatcagcaccctgtcaaaacagaccaatcagctctctgtaaaacggaccaatcagttctctgtaaaatgggccaatcagcaggatgtgggtggggtcagataaaggaataaaagcaggctgcccaagccagcagtggcaacccgctggggtgcccttccacactgtagaagctctgttctttcgctctttgcaataaatcttgctgctgctaactctttgggtccacactgcctttatgagctgtaacactcaccgcgaaggtctgcaacttcactcctgaagccagcgagaccacgaacccaccagaaggaagaaactcagaacacatctgaacatcagaaggaacaagcgctggacccaccacctttaagaactgtaacactccccacgagagtccacagcttcattcttgaagtcagtgagaccaagaacccaccaattccggacgctttttggcgacccagatgggactatcgcctatcaccaagtcgtgagaccattgcctatcactgagtggtgagactgtcacctatcgccaagcagtgagtaccatcagaccccttttgcttgctattctgtcgtatttttccttagaatttgggggctaaataccgggcacctgtcggccagttaaaagcgactagcatggccgctggactaaagaaacgggtgtcaag

SEQ ID NO: 745 - DNA, 1999 bp, Homo sapiens
ccaggcatggtggcacgtgcctgtagtcccagctacccaggaggctgaggcaggaggatggcttgaacccgggaggcggaggttggagtgagccgagattgcacgactgcactccagcctgggcgacagagcgagcctccatctcaaaaaaaataacaattaaaagaatgaaaaaataaaataaaataaataaagggggaactaaagatacaaggggataaggaaagatggaagctgctgctttatggagacaaggtggagggacatcaccatgagaagctatagaggataagcagttgaagctttgcacaaaatgtagatgacaaagatgggtagctctggatggttattttctgcttgtttgttttgcacctgcttaaaaaaaaacacctgatttttttttttctgtattgccaccttccttctttcattaagaagctgctgttatggctccaaataggaccttgtgccatgaagtgcaatctgcactaacacatctacaaatgcatgtcaatcacacctaaagtagaaaaagaaagctcttgtggaattattctaaagtctaatggatttttcttccccactcttaaggggcatctcagcaacaagttgttatggaactgtggcaacatcttaatattcccattctcaaaatagttcagaaaaagtgcatgaaaattgggggaactacttagtaagcacttcaggatagagaatgtagctaaaatgagtaaagtggagaaggagtcaacggcattgtgcacagcattgtattcatagcttgctcccttaaatcgtgtttgggacttggctgctattttggtacagctgctattactcagtgcagaacattaacatatgggggaaattgtatattacacaatgcagcttccacattatgctgacaccattcctctacttgtccatttactttaagagacacttactgatgcaaaggagactgaacagtgaaggatctcactcagaatcctgtccacaatctgtccagtttacaccttaccccaaagaggtaatctcttttgttaattacctgtgtatcttccaattttttcatgataatataataatgactcttcattccctctttttttgacacagaggtagcctgttatacaacgttcttcacctcattctctcacttcacaatatatcttggagatcttaccaaaagcacacagagacctcctgcgttgtgattagattttcattgcataatattccattgttcgtgtgtgtgtgagtgtttagttagtctcaaattgataggtgcatgaatttttccaatcttttgttaaggcaagcagtattgaataaacttgtacataatatttttgcatgtgtataattatatctgtagaatgagtttcaaaaaatgaaattgaaaggtttaaggctgtattcacaaacaattttgaaaggtattgattgcctaattgtcctccaaaaggtttgtcccaaactggactcctataaccaataaatcaaagtgcttgtttctccatagccttgtcaacagagggtgttgccaaacttttaactttttgccaatctgacaggaaagacatgatatctcctgtagtttttcttcttcctctggtaaaagcaaggttaagtgttttttcatgtgtttaataactatttttgtttccttttctgagtttcttcacagttcccgagacagaaaaaaggaaaaaggatttcagcagacagaatttcaacaacaattgtctgttaaaattctttttactttttctttcagagattgctagtctctttcttctcaattttaaggtgcattttaattgctaaagaggtcatttctttggatgtgatatgcatgaaaatatttctataagtttttcatttgtcttttgattttttatgatattttctgctactcggaactgctttttattttatgtagttcagtttattaattttctgtcctatggcttttacgatttggagttacagttag

SEQ ID NO: 746 - DNA, 1440 bp, Homo sapiens
atggaggaagactcactctacttgggaggtgagtggcagttcaaccacttttcaaaactcacatcttctcagccagatgcagcttttcctgaaatccagcggacttctctccctgagaagtcaccactctcatcggagacccgtgtcgacctctgtgacgatttggctcctgtgacaagacagcttgctcccagggagaagcttcctccgagtagcaggagacctgctgcggtgggagctggtctccagaatatgggaaatacctgccacttgaatgcttccctgcagtgcctgacatacacaccgccccttgccaactacatgctgtcctgggagctctctcaaatgtgtcatcgtcccaagtgctgcatgctctgtattatggaagctcacagcacacgggcacctccaccgtcctggccatgtcatccagccctcacaggcattggctgctgacttccatagaggcaagcaggaagatgcccatgaatttctcatattcactgtggatgccattagaaaggcatgccttcccgggcacaagcagctagatcatcactgcaaggacaccatcctcatccaccaaatatttggagggtactagagatctcaaatcaagtgtctctacttccacggcatttcagacaccttcgacccttacctggatatcgccctggatatccaggcagctcagagtgtcaagcaagcttaggaacagttggtgaagcccgaagaactcaatggagagaatgcctatcattgtggtctttgtctccagaaggcgcctgccgccaagacgttaactttacccacttctgccaaggtcctcatccttgtcttgaagagattctccgatgtcacaggcaacaaacttgccaagaatctgcaatatcctgagtgcgttgacatgcagccatacatgtctcagcagaacacaggacctcttttctatgtcctctatgctgttctcgtcgtcaccgggtggagttgtcacaacggacattacttctcttgtgtcaaactcaagaaggccagtggtataaaatggatgatgccgaggtcactgcctctggtatcacttctcctttgagtcaacaggcctatgtcctcttttacatccagaagaatgaatttggaagacccagttacagggtgtccgcaggcagagaaccaagagctctttgtgctgaagacaattgaattgtggtgaaataatatgtcatgaataaatcttgcagcagatttatttgtctcactttgtaatcagtgaatgagctttaacgaatatcaatgcctagtgcctaccccccagagataagaacttccagtttctcatgtgtaatcatggcatctggattgctcatgattctgaagataattctcctgtcccccaaagtttcagaatcacttcaggtggtagaaagagataacacatcagtc

SEQ ID NO: 747 - DNA, 1595 bp, Homo sapiens
gcgagcgctccagggcgggcttggaaatggagacaaactcctccgagccgttaaggctcagccggacagggcttaggagtcccgagcccagtcctgttcacccccattttatagaaagggaaactgaggcccagacaggggaaagtcacttgccgaggtgtttgctgcagactgcgttgaccgaacctgctttttcacagcagtcagacagcaagccctcccgtccctccaggaccctagttcctggggaggaaggcgttctcagcgataatgaccagcattaaagtgctccccgttaccggcgtcactgccccagccagtggaggccccggagagggactgaagatgtgtcacctaacttctctgaaccttcctccctcaaggagaactgataatccctaactcacagttctgtgaggattgaatgccttaagcatgcaggttaagtggctactgaaggcagtttttgtggacaggtgatttgggagcctggaggaagggttacgtgcgcgcgcgtgtgtgcgtgtgtgtgtgcgtgtgtgtaagaatctttccgtgagaggacatctgaggtgccttaggagagtaggagtggacaacagcatccaggcagaaggagcagcatcccaaggatagaaggtggagcagcctggccggcagggatctgaagcccagagagaggaagccactggctccaagtcacagagcagaaactggtcccagcgtcagatctgcgatgctgcccaggcatggtggtgaccctctctaaacaagcacactcagaatttccctggctcggctgggcgactcagaagaaaactggccatcagcttctgcctcaagcgggtgctgtggcaaggaagacagagcatgtgtgttgtgaacactcattagaggatcatccctgctgtgccaggtgccatggcgctggatgcagaaagcaggacacatggaaagatggtgtgttcacaaagaatttggaagaaagccagatggtgacaagagtgtgtctctgaatgccccttttgggggtcactaaaaatgccccagggtttttagttagaccaaaaaggaggcttcaaagagatgacttctgagccgggttgtgatacatctaggatgtcaacaggcagagaaagggcagggactgggagtaaggaaagaacatctgttcaaggcaaaacactgattaccaaagtttctatcatccttatgttgacaacggacataattttaaccttttgtataagccagactgtaaaggattattagcagaataaaagcatctattgggcctggtgcagtggctcacgcctgtaatccaagcactttgggaggccgaggcgggcggatcacctgaggttgggagttagagaccagcctgaccaacatggagaaactctgtctctactaaaaataccaaagtagccgagcgtggtggcacatgcctgtaatctcagctgctcgggaggctgaggcaggagaatcgcttgaacccaggtggcggaggttgcggtgagctgagatcgtgccattgcattccagcctgggcaacaagagcacaactctgtctcaaaaaaaaaaaaaaaaaaaaa

SEQ ID NO: 748 - DNA, 2276 bp, Homo sapiens
tgtgcggacaattttacctgcaaggaagagacccaggacaagcatggaaaagctgtaccgtcttgaacagcaatggccactcagaagctctctgtgctgcaaccgaaggctgggacagttgagagctacagagaaaatgcccaggaaatgtcatactctgggactttagtctgagcctcaggataaaaaataattccatttacgtgtctcagtttattttttagaaatgatctaatatttaatatgtaaacatctccaagaaatggcagctgctgggaaatgaaaattccataatcattactgtcagtatttcaaagtctcttatggaaattgctatattctgtttccatatagtttcacattgtgctaattttgtttattttaatgtgctagaaataactttaaatttgtgtctaaaaaataactaacacggcttccaccctctggaatttatatgcatccaactcccaaagaatatgccttaatttccaactatttaagtcacagagggctaactccagaagatctactgaaaagtattaaatagaagtttcgccacgttgggcaggccagtctcgactcctgacctcaggtgatccacccacttcagcctcccagagtgctgggattacaggtgtgagccaccgggcccggccaagtttaactttttagcatcaggttctttgcagctgctgggccagatataaaatgctagtgaaaacacacatccctttttatctcttaagctattactgtgagtcttatgactacatttgaatcagtgttaccaatcaaacgaagttgaaaaaatcaatttgtgtagatgtgtacatctcactactgtaccttgctgacctccagatattcacgtgcctactgcatattaatctgcatcctggaccatttgcaacaagtagatccccacacatttatgtggggccaattttattcttccggtatttattcttcaaattcaatttgaattcatccttgcaaaaatgtttattgaggccctactgtgtgccagaaggtacatatactacatgttgggaagccacgtttactcatgactcagtcaggacacaagcttcggatatgggctacgcatgtggaaatgcactgcgtttactcatggttccgtttcaaagatagctcccttcacaaattagtttgcacttgccatacctttgtctataaatcatttgtgttgccccaacttctggtctcacagatgcttgcattaaaattgatcattactattgcttttcccataaatatcgttgtttacattttattgccacttgaatttcttctcctaaacatcaagacatctttcgctatccaccacatctacttcttcctttgctatcagaaaacaactggtaaccagttggaaagctgaagcaccactccgagcctggccaacggttctagtccctctcatgtgaatgtgcatgtgtaatgagaggtgacacacacgtgtgtactgtgtatgtgtgtacatatacgtcactaggaatgtcaacatgtcctcgtctttctctaactcctgcagtttctgactccctttcccgtactgcataacacatcatctcaaattcttcatgtgtccctagcgaatgcgatcttgatggtgctttctacctcctgagatacatctcaaagaaaggaaaaagctcattattcccaaggtggagatgaagaataatatgcaagagcctataaagcaggactttgctgaaagacattcgcacccagtaaaatgtggcacatgcaagagcatcagctcagggtctgcctagacacaggccattgagaaagttctgctgtactattccatgtatatgtaaaggtacaaatatctaagaggtctccttgaaagccaaaactggagaccagaaataagccagtaagtagattttaaaagctactctgagttatccatcacatatgtagcctgttttccttacaaaaaccaggccgagcatacaggttgcactgactgtcaaaagaataggtctctcctcctccaaacatttgattattataagtcaaccaaattcaaaagataaaacttccattgcttatatgagaaatctctttctaagacgtattactgtctgatgatttcaatcgtatttcatctctaacctgtacgacatagggcacgttgcctatgtgaaaagagagactgccttcatatcagacagacaagcatttagaatcctctccaatccataagcaacaacagttacccattagggaaaaaaaaagaa

SEQ ID NO: 749 - DNA, 2593 bp, Homo sapiens
ttaaatggtttgtaaccaatgtttgatttgtcaaatccataattctggtaagacaataaaaacttcaggtgatacatttctagcacctgttggatatttgaacacttacagatggattttcttcagttgccactttccatgcatgttttctgcttgcctaaaagattttccatgcaggaaggctaatgctataacagtagctaaatgcttactagaacatatgttttccttatggggcattcctggagaattttccagtcatagaggtactcatttcactggacaagttgtaaaacagttaagtaaggtattacaaacacaatggtattaagcaaagctaatagaatcaattgtattaccttggtaaaaggtattactgactgatggcaatcagacctacccttagtggaaaatacagattaactccttatgaaatagctactggaaggcctatcctcctaataatagaagctcacatgtctcctgctcttacaaactctgacatgacacagtattgcaaggctttaatgcattatgccaaagtactagagaaagattgcccttgaactccattgaagggatcatcctaagtttttctctgtagcaaaattttagggcctcgagtcttggatccttgagttgtggggcttctctcaactcaaaaaggcacctccagactcttacaggctcactggagacctcaaggtaaaactgaccggagaggtttctcttcagaagcagatggcatcctagatgttgacagctttcccaaaatcacagatcatcaagacttctctcttctgtcactgtaagatctttgtcctctttctccttgtatttgttttctgtttatatgtggcaagataatgtgataactaagatttcataattgatagcttctgcagggaacttaactgaatgctgggcagatcatgttaaatctaaattattatgtgaccttagagattctctggttcaccctgtaacaaatttcactgatattccaagtgtggctatctgttcaaattgctcatctggtcctttatgtagggttaggtttttagatttatgggttcagattccctgtttaaatctaagagtagacaaaatctataatgagggttttgcagtaaaattatgccagaaattgactgagaaaaccaaagtaaagataattcaacagtttgtagacaaattaataacattaatcccttaattgtcagtagcctccaaccatgcaatgattcaataatggagccttagataaatattactagtgcttccctactgatgactcttaatgcataagacatcccacagggatctgtctgttgtgcccctctaggatatatttttatctgtgcaagatttaataacaaccatatgtgtgggcaagttcatgtctcaataattaaaaaataaaaaggaccaatgtggattaaggatcctaataatagtgtcactccataaccaattggaaacttcacattggtctaaacctcgtaatttgtagtatgaaataaagaggaatttgccagaaggtataaatgcctctaaatgggcatcttttggcagaatactcctttcttggtttggtataaatgtaaataaagtttgattagaaatctatgttaaacattagctactatagctgactctactgaaaaggatatagttatccagcaaacttctttaaattttcttgcttgagttgttttagataacataattgctttggactatctgttggctgaatggggggagtgtgtgtgatagctaacacctcctgctgcacttggataaatacatctggtatggcagaaactccgttgcaagaaatcaacaaacaagctacttgattaaaacaagtagattccttttctggttcatttttgatatatttgattttgaccagttcaatctgtgggggcccctgttaaggaatatacttcaatctctcagcattattttctgataaccatcataatagtctccctgaggatatgtgccatatcctctcaggaggtttaaatgttcatatgtagccatccgttgtatgtcaaatggtctcactacagttagaaaaacaaaaatatgaagagaatataaagagtcatccaagtgacttgttgttgtgaagtatgaatctcatactgagaacaaacaaccattgttatggtgacagagggtggcatcaatgcccaaggttttggtcaatctctcaaaatggagaaggagaccaaagaggggaaattgttttaaattaattttggcttaaagctgtttctgtatgtaacaactgcaacctaacttaagagtatattcttgtgataagtagctgagtctcagccaatcatagcagctgagcttcagccaatcatagcagctgagcttcagccaatgaaaggttgccgactgatcagaccacgtccatataaggcaaacgctgagctgtaaccaatcaagctgtttctgttgtcactttatttttctgtctgtaaatatgcctgcccacattgctgggtagaggaggttctaagtgcttcccaattcataaattgttctctgctcaaataaactctgctaaatttaa

SEQ ID NO: 750 - DNA, 1701 bp, Homo sapiens
cagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcc

SEQ ID NO: 751 - DNA, 3788 bp, Homo sapiens
atagttctcctccttctcaaaagcccgtcacctccccacaattacatattgccctagcttctttcctgcctcctccttttccttcctttctcatttcttcctctcttccctcattttcttgcccattcccttccttcttccctcttccctcttcagagtaaaaacaaattcctctttttattctttccacaacttagtcatttgtgtgtgtgtgcgtgtgtggccttggctcttgatagcttcaaaatgtcttcttctcccagtgacttatgaacgtattttcttacacacaggcagtatcctctctatgaattcctttcctttttgttctcctgtaatgtccaacctaaatgccatctctccctttcctacacccagacatctgattctacaccctgactctccatcccacttaccaacccccagtcaatggtttgtgtgtttcttgcttagctatttaagcttaattgtctggtgtgccctaaagctgaaatttctctatttttcatgtctagtaccaggttttagttttagtaggtgtttaataactactaaagtaaatctgaaaaagtaaccaaagctgggaagtcactaaatactcactcagtaatcacagcgaaattgaactctgtagccttgtaaaacacttgtctgcatattaccgtgaaaggaggaaattactgggattaatatttcaaagacaacagtagtcccttagtagggaaaatatatcagatgatagccaggaaaatgcattatataaatcctcattcccagtaaaatgtaattcagccttgaccaaaatatataagtaactcatccttgattataaattcatggttaactgataagaatctgagaggtttctttagatacctcttaaaatatctaaagaattcagcgatgctgagtaggatctagataaaaactatctggcagaaaagctttgtctcacaaggtgttacctacctgcttttaggacagcttggcacatagtaggagatgaagtgcttgatgattgactgaaatgtacaaggagaaatgtacaagactacaccacgggtggcagagatattgaacacagcctgtcaccttgccctgtaagatctctggctgtgtatccactttttgagcaagagacttgagttcagaagacctgaattttaatctctcagctctgctataaatgtgggatcctcagtaagtaattttacttctctggacttggttttatcacctgtaaaatgaaaaccgtgggcttaatagatctctcatataggcttgagttgcttgtatgactgtctgtagttgtttttagaaaagtaatgacaagtacatggaaataaatattcaaatactgtagagggcaggtaataaggaaatgtcatctttcctgtgccctgactcccaggtctttctcccaggtcttagagtaagcccctttggctaattctgtcttattcctctaaataatatgttaagtctctgtttcttcatttgttaatctacacaataccatttgtctttgtattattcaaggtaagaaatttagcatactaccatcaatattttaattttagatatatatttttatgatttacatccatttcttttattacttaaatagaattaaagcactatttcttaacccatcagttttaagtagtattcctgactctctttgctttcttccacttctcctcccccttatatttcctagcttctgtcagttaaatcatcacttttatattgtccaaagttataatatttaaattctcttttataactctggttgtcttaagtgctgtaactataggttaattctgaaaattgaaagtcaatacagtatcattatgtgaatattatttactgcaaaactacgaaatatgcctggacgtgcagatgacaaggtagtcctgtttcaccaaacctgggccacttgaacaagaatgctccaagcattgaagtcacattaattctcttattatactccacaagttgctcaaaatcattctacatttttagctggcttcgtattgtgaatggctttaattttcaaataccctcaaacttgaaatttagattggtagttctcaaacttgactgtacattggaattactgagggagctttaagaaatctaatagttagaggatcccaagtctagggtttctgatttaattgagctggggtgtggcctgagcatctcagtttttaaaattttgcggcttgattccaatgactagcaagagttgaagacctttactgttgaaacccagtcatgtctagtagagtcaaaagtaatgaaatacactgagtctttggacagcaagagcagaaaagtgaaacccgatagcagctgaaggtttatagaatatttatttcttttttggttgcagctatctccttcccaacctaccactgctaagactgtttcataagatgcacttctctacactcagctaatgaggtgtttcaatcagcagttgttctttggatgaggagccgatattgttttaaagcctattattttcttgggtgggtattctggagcatggggagctgaaagtgttgcaaggaaactgctgtgtgaaatttgatcaggtccttggtattcatttttatgtttcaataactgatttattttttcccccttgtacttaagatttaacatgtgttgtatttccagcagttcaaatctaattgtgtcgaatttccaggattggaggaaaagttgctccctttcagccctcctactagaagcactggagctaggctggcgggcattggaccctagtaggtatagcaggctgtgaagagcgactgggtggaagcagccccagaagaacccgtgtgaacatactgtcctttggccgcctggcagttagcctagaagacaaatatgagagaggagactggttagagtaaatgtgaccccaccttgaccctgtctgcctctcatgggaaaccagtcaaaccttcactcagattttcttctttttacagcaatgttgctgaatattgctggggataccatccccttctataaagtatctcccctttttatcccagttttctgagcatttctttggtaagcttgaggtttgtgtcagttactggggaaatctctgttcagtaccaacaatattgcagcaacagtactagaaactaaagttgaaaaatttctcactagtatagtacactataccaaaagaaaaacatgtttattttaaaaacatttccattttctacctatattggtctagaagaatatgtaatttttatttagttattgtagtatcatttgctttcctgtatacattccagttaaagataaattcagaattatgaaacttacgacaatatttgaatgtcactcagtggtaccacttcttccagtcagtgttgctattgtctgttctctccaggacttatttctacattttacatcaatggttctccaactgtgtttcatggtctaccagcatcccttaggaacatgttaaaaatagaaattccctggccttacccctgacctactgaattagaaactcagtgggtgagacccataatctgcatttttaacaagcgcttcaagtgggggtaggggaaatgaaaagaggttggtaatgggtacaaaaatacagttaggcagaaggaataagttctagtgtttgatacaacagtaagatgactatagttaacaatgatttattacatattttaaaatagctggaagagaagatttggaatgttccaaacccaaagaaataataaatatttggagtg

SEQ ID NO: 752 - DNA, 2261 bp, Homo sapiens
atcagacttagcagcatcttcctgtcccaagagaagaggggatgggaggatggcatggttcagggcttaggggaggataggggagaaaaagtggaagcaaagggagaggcccaggaaggattttgttgcgacatgttacctgggctgcacctgctgtatgcaagagaagaggctgggagtcccctctgcagggtgttcatgccccatctctgtgccacgaggagttgggctgctgaaggtgagtacagggaggttccctgtcatctcaaacctctcaggctccacagtactgtttcaagtatccagagctttcctgcctttgaaaagcaaaaagttgtctcaggagagacagtgtgatttttgcaaggtcatgcagggtcacacaagttaatagcaaaactatagtcagaattcagactttctaacacaagcatatgacatgtatacttgtcccaggactctatgttctatgttttcctcttgtcacatttatggatccagtccaaggcagagagaacatgactctgaggtcaggcagatctgcaagggaatagcagttcttctcaggattgttgaagaaattaaatgagctcgaatatgtgagtgcctagcctagtacctggcatggggggttatgcattcagtgtgttgctctccttcccttccaaggtagcctggctgttatctcctttctggaaactcattgagcatcagagatcttgacctccttgggcacactcctgagtttatttaggcctacatttataggatgtgtcaggagctcaagtactttatgaacagagattaattgctcttatgatttaatgcattggccacccacactggtgagatgctccctgaactatgctatttgagaaacaatgaaggaactttgtgaggctaataagatttgtgctgttaatttaagtcttgaggatgtggactacagagagtataacattttatagaatttgtttaaagctacactctcatctttgccataacctggcctttcataatacattcccgtggccacctagcatcatgggtaaggctctcatcaaatgcttcttggagagcaatgcatcttgcagaacaggaggtgggaaatttccacaagggaatgactatgaatggggtgggagaaagacagggaagcaggggaagatcatttccattatttgttcagtggtgattttgggtgaacatctctctttagtccagaatgggcaggaaaatgatatgaattgtaattgttggcaagtgcgaaataatatatttagtgaggaatgtagtgtgaagcacatgaaactgcactgtcaggaagagaagttgaatctggggtcagaagaactggtttccattcctggttctgcaaactgccatcaaacttgaaggactcattctgaggcagagaatgaataaatcattacctttgtgaagcatcagaatcagcagcactttcctgtcccaggagaagagggaaggggaggatggcacgtttcagggcttaggggaggataggggagaaaaagtgagaagggaggctgacagaagtgttgcagacactgcaacacttgcatacttaacactgtatactaaagtagatgttaacctgcgctgcaatctgtatatgctgattcagctgtaatccagtcgctcacttgttacactcttacattttcaccagtaagtagtccttgtgcctccttgtatgggtggcccagtctctgatactagatcagcagcttcagcttcatgcagagtccttcctttgaaaaaccagcttttgcttgattttattataggatcttggtctcatgttagtgtctctctacctcagtcttcccagaatgtaggaattcttgcccataatattaggccagtacttttgttctaggcttatctcaacagacctgatatccaccttttctcttcctattactcagtaagcatccatctttagattgtgaacatacaagacgctggcctttatagggcctcttatctctgtcacagcatggagttttcatgaaaacaaggggctgagaactctgctggcacatagtaggcactcaggacaggttagctgctttcaatattatttttctgttcgtagatgtcttagcatgattattatttttactgaaacccacccaaattatccatatggaacagtgggctctgacccaggaaaggggggcccaggaattactgtactgcctgttgagcacgtgccttagtgtgtccatctgtctgct

SEQ ID NO: 753 - DNA, 2854 bp, Homo sapiens
agtttcagtgtcttcctgtggtctgtgaagaagagaaacttaacaacaagaagagggaaagggaaggtcgcctaaggagaagacacaggagtaatgagaagacacaggaggtagagcagcacttgctgactcagaagcattaacatgaaacgctggagtgcagggcacaataatggttgactgcagcctcaacctccagggctcaagggatccttccacctcagcctccccagtagttgggattacacagatatttcaagattcagcatcatttcagaccctgaaaaatccctgaaaattgaattctcaatagataatgcaactccacataatatctggattttgtaaatgcttgctaataaattattttacaacgtgggtgagtttaggtgtgtaggtgatttccacacattgagagccaaaacatcaaattttaatgttggtctggtgaaagagacataatatttgatggttcatgaagaatactacaacataataagcattttagatccagggttatttctttgtatgacttatttccttttatggccatcaatccaaattttaaaaataattttttaatatatttaagatgttgtcatgtgtcctaaaatgacaaaaataaattagacacatgtttaatcatcattccagtttggtttattcactcatattttattgcataaaacaagtcaaattatttagcatgatgtcaaagtcttaagtgtaaacctcttgggggaaacagcaaagaattgggaagaatattacagtctatcatgtgaatttcatcaccacaatcagaaactaacacaaaacccagaagaaaccctaagaaagatacctgtaacctgaagaagatgtagactagatgccaaagacagagaatgatctgaatggaaaattttgcagctaaactattttcccttttttgtatgtatcagggcaaaacagtgcctaattttctcctcattttctatcatgaggcaagaaaacacatctgtcaaatgtggcagggtaacctcagagaaaagctggagacaagctatggtcataaatgtatgctaaatagatggttcaacataagaaaatgtaacaagttaattcaacacattcatagacttgacttcaagagaaaatttaggcagcattgcaatagaagcagaaacacatttgaaaaagtccagtatttatttgttaaaaactcataccaaattgtaaagaacattgatgctatgaagaaactgcatcaactagtgggcaaaataatcagctaggcttcataatggcaggattaaatgcatacctaacactattaaccttaaatgtaaatgggctaattgccccaattaaaagacacagactggcaaattgaataaagaatcaagacccatcagagtgctgtatgcaggagacccatctcatgtgcaaagacacacataggctcaaaataaagggatggaggaatatttaccaagcaaatggaaagccaaaaaaaaaaaaaaaaaaaatgcaggggttgcaatcccagtctctgataaaacagacttcaaaccaacaaagttcaaaagagacaaataagggcattacataatggtaaagagatcaatgcaacaagaagaattaactatccaaaatatatgcacccaatacaagagcacccagattcataaagcaagttcttagaaacctacaaagatacttagactcccacacaataatagtgggagactttaagacaccactgtcaatattagacagatcaacaagtcagaatattaacaaggatatccaggatttgaactcatctctggaacaagtggacctaatagacatctacagatctctccactccaaatcaacagaatatacattcttctcagcaccacactgcacttattctaaagttgaccacatcattggaagtaaaacacttctcagcaaatgcaaaagaacggaaatcataacaaactgtctatcagaccacagtgcaatcaaattagaactcaggattaagaaactcactcaaaattgcacaactacatggaaactgaacaacctgctcctgaatgactactgggaaaataacgaaatgaaggcagaaataaagatgttctttgagaccaacaagaacaaagacacaacgtaccacaatctttgggacacatttaaagcagtatgtagagggaaatttatagtactaaatgcccacaagagaaagcaggaaagatctaaaatcgccaccctaacatcacatttaaaagaactagagaagcaggaacaaacaaattcaaaagctagcagaagtcaagaaataagtaagatcagaacagaactgaaagagagagagacacaaaaaacccttcaaaaactcaatgaatccaggaacaggatttctgaaaagatcaacacaattgatagaccactagccagacttataaagaagaaaagatagaagaatctaatagatggaataaaaaatgataaaggggatatcaacaccaatccaacagaaataaaaactagcatcatagaatactataaacacttctatgcaaataaactagaaaatctagaagaaatggataagttcctggacatatacaccctcccaagactaaaccaggaagaagtcgaatccctgaatagaccagtaacaagttctgaaattgaggcagcaattaatagcctaccaaccaaaaaaaaagtctaggaccagacggattcacagccaaatgctaccagaggtacaaaaacgagctggtaccatttcttctgaaactattctaaacaacagctatccctaactcatttgatgagaccagcatcatcctgataccaaaacctggcagag

SEQ ID NO: 754 - DNA, 5536 bp, Homo sapiens
cctaagtttagtagaagaaaggagagaaaatatagcctagcttataaatttaaaaaaaaatttatttggtccattttgtgaaaaacataaaaaaagaactgtcacatcttaatttaaaaaatatatgcttagtggtaaggagatatatgtcaacttttaagaggttgaaaaacaaacgcctcccattataagtttatacttcacctcccaccactataacaacccagaatccatgagggcattattacaggtttgttacacaggtatacacgtgccatggttgtttgctgcacccatcaactcaccatctacattaggtatttctcctaacgttatccctctccttgcctcccacctcccgacaggcctatgtccatgtgtactcgatgtttagctcccccttgtaggtgagaacatgtggtatttggttttctgtttcagtgttaattcacttaggataatggcctccaactgcattcatgctgctgcaaaggatgtgactttcttcttattagctgcatatattttgtggtggatttgtaccacatttactttatctagtccaaagttgttgggcacccaggtggattccatgtctttgctattgtgaatagattccttaaggatctagaaccagaaataccatttgacccagcaatcccattactgggtatatacccaaaggatgataaatctttccactctaaagacacatgcacacgtatgtttattgcagtaatacttacaatagcaaagacttggaaccaacccaaatgcccatcagtgatagactggataaagaaaatgcagcacatatacaccatggaatactatgcagctataaaaaagaatgagttgaaggatccagccccaaatgttaatagtgctaatactgaaaaatccacttctaaaacaagtgtcagctgagcgtgatagtgcacacctgtaagcccagcacttcgggaggccagggcaggaggattgggcagtccagagagagagcttctgggggcagctgcgacctcactgggatcaactgggattctggggccagttaagtccgttttccacgttgactcttccagaaccagaaatgtgcacactgaacccactcctgctgaagaagactgctgtgactgatgcagatatgctaacaggcacaggaaaaggatccaggtgactttcttgttaaagaagtgcatgcattttctatccaccgaaacccacacaacgaaatataatacagtttaaatataacaaataacatatgacaagtttaaattttttaaatgtttaagtatacagtagtccccccaccaccttacatgttccaagacccccagtggattcttgaaaccaaggatagtattgaaccttatatacactatgttttttcctgtatatatgataaggtttaatttatgaattaggcacagtatagattaacaacaataaccaataataaaatagaagaaccaagtggcccataaccatatgacaagatgctgtgtcaggagagctcttggctgtaagtaaagagcacctaactaacaatagctcaaactaatttgggtttacattctcacataccaaaaaatcccatgctccaatacggaggagtctcagaaacattattctaagtggaaaaagccaggcacaaaggtcacatattgcataattgcatttatttgaaatatccagaatgggcaaatttgcagagacagaaaatagattggtcgttgccaggggctgggatgaggagggaaaggagagtaattgcttaatggttatgaagttttattttgggatgatgaaaatgttttaaagctggatagaggtgatgggctattactaggtaagtttcagggaagtcaaaagttatacacagattttcaactgcacgagggggttggccctccccctactcccatgttgtccaaaggtcaactgtactataaattcttgttacctatagtcaccctactgtgctctcaaaccctagaacctattccttctaactgtattttgcacccaatgttcccaacacaaacatgataaatgtttgaggtgatgaatatgccaattaccccatgaaatgcaggcaggcttctgatgattgtgaaatggaatcttatgcaaaaaaaaacaaatagcctttccttgcagccagccagtgtttaggcagcacctgccacacacccagcactgggacagcttctttgactgttgagccgcttttcctgtttcttttctctttctttaactcttacacccattattcgaatattctaatcagatctatcaatcaaagcaaatactacttgccaagaattgagctacatgctaaggttacagtggagcaaaaacaacaaagtccctttcttcttgaagcttatagtctattggataaatacatattaaatatttaactgcaaaaacaatgtatttcagccatgaaatcaaaatggatcagaaacataaacattaaagctaaaactaataaaaatctacaggaaaacataaaagcttcacaacactggctttggcaatgatttcttgggtatgacgacaaaagtgcaagtgacagaaggaaaaatagatcacttggacttaaacgagattaaaaactgttgtgcatcaaaggacacggtgaaagggcaacccatggaatgggagaaaaaactgccaaccaaaaatacatagaacacttaaaaatggtttaaataattttatctatattttaccataattatatatacacatgtatatatgtgtatatatagtgtgtatatatacagacatatatacacttgtatatatacaagtgtatatcccaggttggtctcaaacccctggcctcaagccatcccccagccctggcatcccaaaatgctgggattgcaggcctgagccactgtgcccagcctaactcactcttcttgagcaatgtagggaagcaggtagtaaactgaagtgccacatgcttgggccagattccttcttgcctcagggcctttgcacatgctgttctctctctggctgctcttccctacatcccacccccctcacttacccgagaagcttgaagaacggggatcctctcctgtgggcaggggagccccagcttccctcgtgattcccgtcctttcaagttcattatggcagctctgtcaatgagcaccccagggtggtgtggccgcagcaccaggacccgcgctgaaggcccagagacctggcaggccgggaagaaattcctttcctttgggaagaaccaccaacgctcagtccaagctcacacggttatctagtcggcaatgccaaaaaaccacggctacaaatgaactggtgagctggctcctgctctgagactgccagagcttctggtttccactgccttggagactgctgtctgcatttgcttagacaacccttagcgaggccttcatctgctcttggtcgctgtcaaccccccacccgacagccggtgccgtgtagaaacagatcgtccctgtgagacactggagctggaccatcgactccactgcactgcccgagattgaggagccagagaaaggcccggcaagcccaagtcggaactccctccagatgctcccgagccccatggcggcaggcgtttctttgttaggcttttctggggtcatggagattttctcggccctctctgtgagcctctagccttcctccctttcacctcctctctcccactgtatttcccatgtactccagcaacggaacaaaacccaaagcagtgcccttgtattaactggctagctgggctacccctacatagtgaaactaaggttgagattggccagaagccagattaatgaaaaataaaattgtgattcatttccaggcctcttaaacctgaatggtcagattttgtggctgagattgatgagtccaagttgccaatgttggggctatttattgtcaatagtaatttcattaaaaaacactcctgaagggaggtatctgccatggtgtgcgtgggtgtaccgcctcgccaccggcaggcacaactgctctagattaagaagctcaaaatatacgacagagctacagtaaacaaaacagcatggtactggcataaaaagacacatagaccaatggaacagaatagagaacacagaaataaatcgatatacttacagccaactgatttttgacaaaggtgccaagaacacacaacggaaaccaccaaagtgtctagctaccaatgaatgagtaaaggaaatgtggtacatatgcacaacggaatactattcagccattaaaaagaatgtttggttactctaggcacctcatgtaagtagaatcatacaaaatttgtccttttgtgactcgcttatttcactgagcataatgtcctcaaggttcatccatgttgtcgcacgtgtcagagtgtcctttctttttaagactgaataatattccattgtgcagctgaacctcattttgcttatctattcatctgtggatggacgcttgcattgcttccaccttttggctgttgtgaatatgctgccttttagccacttattcagaaaaaaaaaaaaaattaaacacggcacaggccaaataaaagcacatttgcaggtccctgcagccggacagccatgagctttgacctctgcactcattgaatctctctcctgactgacttctatctttctactctctgtaggaaatatcacaaaggtgttaccatatggagaggtgaggaggagtgtgctgcccaaaaagtggtgtttcaggctcttgtataatcacatgaacatctttaataagattctggatacaagaatttaaagtagtaattagtctcaaaaaaaaaaagaaaaaaaaaaccaacatgggcaacagcagtccaggaaaacttcatggaagttgaaagaaagccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactgggaaggaagactcaaaatttaaaaatagaaaaaaaaatgatggcccagaagagcaagttcagagtgctgttcatgagtgatccgcatgggaccgcgatgcctctgacgtctgccatcctggagagcagcagagcgtcactagcagccaaacaggaagacaagtgtttcacggacataagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaacctcagctctcagccttgaaaacaaggatggctgtactactcacttttttcttcttcttcc

SEQ ID NO: 755 - DNA, 3715 bp, Homo sapiens
aggcgcgagcttcctgcgcctgctcagcagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttggcaggaggagaaaaggaaatgacatcagaggtgctttgctaaagatcacaggaactgcagctgtggccttcctatttcgcagttttccccttaaatctttacacagattcccatcagagtacagtaaaacaaaaattaaatagaattcatatatttgaaatccttggcatcaattcactccaggaatccaagacagtactcaactgaaggggaagcaagcacaagggagatttctgggacactgatactgttccgtttcttcatctgaatgctgcttatgggccttgttcaatttgtgaaaattcatgactttgtacatttatgggtttcactttgtagctcaggctggtcttgaactgctgggctcaaactatcgtcctgcctcagtctcctgagtggatgggattataagcacacaccaccgtccctggcataaaatagttttttaattcacaagatttaataggtagattaaaagaagaggtaagacaaaattaaaagaggtaagacaagagaaggaaaagtcagactgacagattataagttcctatggtacacagtccccttagattggaagaaaggagctaagagggtaaggaagcttggttgccagttttttataactggcagcctggtgatattgggtgtggtagctgagatgtcccaattgtagtcacaaggcctaaaaaagcagatctttacaaatgtttaaaaatactagctcaatgtaaataagcatgaatgttcttgacctccttactgtgccctgaatgtgccaaccacactctcattccaccatctttgctcctgcaatgctgtttgcctgcaggccttcctgccaggagcttgctccttctctctgtccactctggatataacagcccttgcccttctccactttacgctctcttccctttctcttcttgtacctttattttcctgcatagcacccatgattatctgatctatttttttccctttttttttcattctggtgcccaggctggagtgcagtggcacaatattggcttactgcagcctcagcttccctggctcaagccatctgcccaccttagcctcccgagtagctgggactgcaggtgcacgccaccatacccgggaaatttttgtactttttttgtagagacagggtcttgctatgttgcccaagctggtcttgaactcctgagctcaagcaatccacacaccttgacctcccaaagtgctgggattacaggcatgagccactgcacccagcctgatctattatttatttaccagtaccttccctactggaatgaaagctccatgagaacagagtctgttttgttcactgctataccccttgtgccaagaacactgtctgacatataacagtaactggaatatttaatgaatgaatgaatgaatctaggtatatgatggtgggatgaggaaataaagagatagaaaatgtcagtactgtataggtttcagggacaatgaattatcaatacaatgatatattgcctgaatttcagcatatcttagtaactgccttaaagttacagaaggactgagataatctgttagaatgtgaacaataagagcacctacctcacagtatccacataaattgtttagtgcagtgcctggcacagagtaaatgctcaacagttgttagttatgattaagtctgaatagtaactcacacactaaagtaaaattgaggatttgaaacagaaatcaggatttccgttcctcctttgttaaaactaggcacagtattcaacagtctaatcaatttctaaaagtaccatttaaaactgaggtatttagtaaatggtttatagactacttagctctgtaactgaaataaattattctccaaacacggctttcctcaatgagcttaatgaatgttttctgtttaccattattgatgcttttacaaatatctcctatgcctccagaatgatctcggtgccagtgagtcactacaatttcctggattgctgtgttaaattcagttagagcctgctttaaacagctgatgtattctggaattgctggttctccagtgtcaatgaggattctcctgaaaattaaatggaagataatcacacaattggaacactgcgttgacattagcattattttgcacacagataatttacattaaagaaactgcaaaaattattttacttttaacatgcacaaaaaccagctacatcacttcagcttaactacagtaatctcaccctaagaaagttttctgagaaaaattagagctaaatataagtctgaacaaggaataatagcagtcatcttgaacatttacatagcaattaaaataaacatggcaccattccaaggactttacatattttaccaattacattcctcgtaacaactgtttaaagtagatattttatcattatatttagaagtaacttgcccaggttactctacagataaatggcagaaacagctttcaaacccaggtattctgatgccagaatatgtgcttttatctatctgcctttgagatctcatatctcagtatatttcaaaagttttatagatatgaaagattttgattcaatggcacccctaaagaaactagtctttggcactagatatacaacttatcactgaagttttatattagcaccctgacacatgaaaatgaaggctttagtgaagcatgggaaaaacatctgagctattttctttctttacttagacaaccccattagctgtattttttgcttgtggttctgaatcttccttatattttgtttgcccttcctcacgattttatgaggtggcctttctctgtgaagttttgctgaactaaagacatgggggtgacatgttcctcaagatccaattcttttttttttgagacagggtcttgctctgtcacccaggctggagtgcagtgttgcgatctcagctcattgcagccttgacctcctgggcacaagcgattctcccacatctacttcctgagtagctgggactacaggtatgtgccaccatgcccggctcatttttgtattttttgtagagatggtgtttcgtcatattgcccaggctggtctcttaactcctggggtcaagcaatcctcccacctcagcctcccaaagtgctgggattacaggcgttgagccaccatgcccagctcaagatccaattcacaaacttcttcactcatactgtttcacagtaacacctcaataattcaggctggctgacagattagccttgatgaaaagtctgagttattcattaattgatcaataactgtttatggattacctaatatgtgctacaaatttgtttcttgcagtaagcaggacacaacaaccctgcttacattcaactgttggtgagaaggggaactgcatatgactggaaataaacaataaaagtaacataccatagaaagcattttgcaaagcattaaaattaa

SEQ ID NO: 756 - DNA, 3011 bp, Homo sapiens
ggtagcaggcggaagtgcggccctcgaggcggtcgcggcctgtcggggcttggagcgaatggctccaaggccgcaggctgggcctgggccgcagccgtgggaagccgacgatgcctgaggcgctctgtcctcggcccaccctaggaacttgtatgaccgcaggaaaggatcaggagaggccgctgcccgtctcccaccggctctaggctccctcggccgaccgatgtggggaaggggaaggggcccgcgccgaggctctaggggaggctcctaggccgggttctctgacttaaggccctcttggctgtggttttgcgggagtgagttgagggagctgcattcactcaagtccctcacatgcccgagggcccgggaatcgtgaagccgggcctgcggacccggtgggaggaaggagtgcgaagcgcggccgccgtgctcggccggcgccgggctaggtcgggcggtggggaccgcgccggcataggacaacgcggtggagggaagcacctgcccccgcccaccttgactcagggccgccgcgcccctcctgggccatccgcgcgggggtctcaggatggcgaaacccgggacctcgcggccctctagtgctcccctgccagggtgcgacctaggtaccctttatcgagccccactccccaaggcagagagagttcgacgttcccaaggagggagtctccatggaggaattcgtcctgcttcacttccagagttgaaagcccgtcggttctgcaaagaggagcagtcgggcgcgggctagcaagcagctgatgaaaataattgtcctcgcacacacagccctgcgcccaggggcgcgcgcgcgcacacacacacacacacacacacacacacacacacacacaacttgcctcctctagccgcccaaccttaatattccgggcatgcagttttcaacaacttgcctgacacaataacaaagacatttaaatgccaggacgcagacttcactttttaacctgctgagaggagctactttcaaagcttccccaccgcgaataaactgacaaaaaatatggggtgcacttataaattaaacaccttaccctcaaagcaatatacgttaatcaggtttctaaggcaatagccatctctgtcttttcctattcacccaaataatgcccccagaaggaacccctttacacaagagagaactggaaaaaaaatgaattatacccattgctagtaaaaaatcatcttaaatcaatagagcaccacttgaacttgagtttctattgtttcactgaatcatcaatgtttttaattaaacagagctaccctttctgttaaaacattacataaaagggttaggtttctacttttgttgaggcagctggcgtttgttggctgttgtgtttgagcaacagactgttcaatggaagcgagaaatagctcaacgcgctcttaatagacctgtttcaacaatgtatcttgaaaaggaatacattgtgttattgtgttagtttgctacaaacctattaaaagaaaaatagcatccatcaggtctaacaagacgcatttgtattatacgtacttatctgcttcaaatacacttcttggcacaatgtctagaattcaactagatcatcaggagctgggcagaagaacgcataccagttaggtaatgatacacgggctaaaaataataataaaggaaggactaagcagacggtaattgctacttttttgtgtatcatgagaaataacaggcaaccctacttcaattaaaaatatattgcaaaagtgtggactcctacgacaaaaacaatttaaaaaatatttgtagcatgggaatattgatccatatcccatatttggaacgaatctgatacactttcgataggaatttgtttcagagaaggattcagggcagaagcgatgcatttttaaagcagaattaaaacagcgcaaagagcccggctctttagggaaatgcgcgaaacaaacaaatcgaaagcaagcgttccagccaagtggttggggagcaccgttgtctggcactaggaaaggaagtgcttcttgaaagtgttctcttaaaaatgattttccagacttattttattgcattttaatcacaaagtgaaacttaaagcaaagaaacaggacattcccgctaccgaacagaacctatcgtctattgcaggaatgactgctacttggaccacagacctttagaaaaaacagagaggcaaatgattaggctaatttaacgcggagatctgcttagcagaaaagacacccaaagtagcatctgtcagaggaaaacatcttttgcttccacacaaggcactcgatttggtttccaaccttgagtcctcaacattcaactttcaagtgcaacaatgttggaggcacaagagaatagtagattacctacaagtgaacacaattgtacggaaaagagacttacataagttacaatggcaccctatgtgagatatctactttaacaaatatgtagagcaatattttgcccaataaagtcaatcatttgttacatttttgaataagtaaattatcacatgaagatttagaaaaatgttaccctgaaacattaaacgatagttttgccatattacaaaatagctattttaaacttttgtataaggcatttgaagccaaatggctgatatgactgttctcttcagctggaacattttttttcttctcaagaagggtgtgtgtgaatgatgtgtgtgcatactggaggtagttgagaagaatttgattaatacataagacttttcactaatgtctcccctctaatccaaatttactttttaaattaattcacttggatttaaaaacagaaatgagataataaaccacaaattacacattataaaaattagtttctccaatgtatatgatttttggaagagtgcattttcaaggtgagaatttttgatgtgtctgataatctgccagatatgagaggaatgtcacaataaaattggttttgccatgatatgaaa

SEQ ID NO: 757 - DNA, 3010 bp, Homo sapiens
ggtagcaggcggaagtgcggccctcgaggcggtcgcggcctgtcggggcttggagcgaatggctccaaggccgcaggctgggcctgggccgcagccgtgggaagccgacgatgcctgaggcgctctgtcctcggcccaccctaggaacttgtatgaccgcaggaaaggatcaggagaggccgctgcccgtctcccaccggctctaggctccctcggccgaccgatgtggggaaggggaaggggcccgcgccgaggctctaggggaggctcctaggccgggttctctgacttaaggccctcttggctgtggttttgcgggagtgagttgagggagctgcattcactcaagtccctcacatgcccgagggcccgggaatcgtgaagccgggcctgcggacccggtgggaggaaggagtgcgaagcgcggccgccgtgctcggccggcgccgggctaggtcgggcggtggggaccgcgccggcataggacaacgcggtggagggaagcacctgcccccgcccaccttgactcagggccgccgcgcccctcctgggccatccgcgcgggggtctcaggatggcgaaacccgggacctcgcggccctctagtgctcccctgccagggtgcgacctaggtaccctttatcgagccccactccccaaggcagagagagttcgacgttcccaaggagggagtctccatggaggaattcgtcctgcttcacttccagagttgaaagcccgtcggttctgcaaagaggagcagtcgggcgcgggctagcaagcagctgatgaaaataattgtcctcgcacacacagccctgcgcccaggggcgcgcgcgcgcacacacacacacacacacacacacacacacacacacacaacttgcctcctctagccgcccaaccttaatattccgggcatgcagttttcaacaacttgcctgacacaataacaaagacatttaaatgccaggacgcagacttcactttttaacctgctgagaggagctactttcaaagcttccccaccgcgaataaactgacaaaaaatatggggtgcacttataaattaaacaccttaccctcaaagcaatatacgttaatcaggtttctaaggcaatagccatctctgtcttttcctattcacccaaataatgcccccagaaggaacccctttacacaagagagaactggaaaaaaaatgaattatacccattgctagtaaaaaatcatcttaaatcaatagagcaccacttgaacttgagtttctattgtttcactgaatcatcaatgtttttaattaaacagagctaccctttctgttaaaacattacataaaagggttaggtttctacttttgttgaggcagctggcgtttgttggctgttgtgtttgagcaacagactgttcaatggaagcgagaaatagctcaacgcgctcttaatagacctgtttcaacaatgtatcttgaaaaggaatacattgtgttattgtgttagtttgctacaaacctattaaaagaaaaatagcatccatcaggtctaacaagacgcatttgtattatacgtacttatctgcttcaaatacacttcttggcacaatgtctagaattcaactagatcatcaggagctgggcagaagaacgcataccagttaggtaatgatacacgggctaaaaataataataaaggaaggactaagcagacggtaattgctacttttttgtgtatcatgagaaataacaggcaaccctacttcaattaaaaatatattgcaaaagtgtggactcctacgacaaaaacaatttaaaaaatatttgtagcatgggaatattgatccatatcccatatttggaacgaatctgatacactttcgataggaatttgtttcagagaaggattcagggcagaagcgatgcatttttaaagcagaattaaaacagcgcaaagagcccggctctttagggaaatgcgcgaaacaaacaaatcgaaagcaagcgttccagccaagtggttggggagcaccgttgtctggcactaggaaaggaagtgcttcttgaaagtgttctcttaaaaatgattttccagacttattttattgcattttaatcacaaagtgaaacttaaagcaaagaaacaggacattcccgctaccgaacagaacctatcgtctattgcaggaatgactgctacttggaccacagacctttagaaaaaacagagaggcaaatgattaggctaatttaacgcggagatctgcttagcagaaaagacacccaaagtagcatctgtcagaggaaaacatcttttgcttccacacaaggcactcgatttggtttccaaccttgagtcctcaacattcaactttcaagtgcaacaatgttggaggcacaagagaatagtagattacctacaagtgaacacaattgtacggaaaagagacttacataagttacaatggcaccctatgtgagatatctactttaacaaatatgtagagcaatattttgcccaataaagtcaatcatttgttacatttttgaataagtaaattatcacatgaagatttagaaaaatgttaccctgaaacattaaacgatagttttgccatattacaaaatagctattttaaacttttgtataaggcatttgaagccaaatggctgatatgactgttctcttcagctggaacattttttttcttctcaagaagggtgtgtgtgaatgatgtgtgtgcatactggaggtagttgagaagaatttgattaatacataagacttttcactaatgtctcccctctaatccaaatttactttttaaattaattcacttggatttaaaaacagaaatgagataataaaccacaaattacacattataaaaattagtttctccaatgtatatgatttttggaagagtgcattttcaaggtgagaatttttgatgtgtctgataatctgccagatatgagaggaatgtcacaataaaattggttttgccatgatatgaa

SEQ ID NO: 758 - DNA, 3822 bp, Homo sapiens
ggaaagccaggcttgcatgaaggaaatgatttcctatgattctgcttactgcttaaaaaaattaatcaagttttctgcctgacaagatccagtatctgccggaggagccccaccttctgctactattatgttcttcagatgagtagaagagagtggggagggagagagcaggaagaagaaaggaagaataatgtcttgaaattgatgatgcatatcataaattattactcaccccatgttcccaccctcgagagacctccaaacaatcaccatgccacagtgaacattcagtaacaaaaattcagccagggttttcaccagcatgaatggcagtgattccaatcaggaaaacagaaagaggagagttcagagccacctagaatggctcttgcaagatacgaaatcaaggcagcagcaacagggctgaacattcctcatccctaactctcccttcaccagtaggaaacccaggataactgcaatcaccgcaggcccatctggcctgaagttctactactagtagccctccatgggaccttcttaaggaagcatgtcaactcaggtaagggatgtaaggggatggatgaccctttgaggccaaagttggagcaaaaaacaccagatgttcctgtgcactgctcctaagagatggttctgaagaccagttcggggagaggtcaaaatactggacagaatctcagcaacatggaacctcaaactaagtgacagtcacagacaactcttccccaaagaaaataagcacagacatggtttgtggtaagcagaattataaagatgaattcccatctccctgtcagattaccagtatggtaaattaccagattacctggttatttattcaaacactaatacagttattgccttgatggaaacatacagatacaattaaaatcccaagtaccaaataaattgaccttaagacaaagactaagtaaatcacatgagccctctacaagcagagagtttttctccagctggtagcagaagccagagatttgaagcataggaagtattcaacacattattgctggcctgaaaatggaaggggccacataacgagggaaaccggtggcctctagaagcagggagcagtcccctgctgacagacagcaagccaagacctcagttctacaattgcaagacactcaattctgctaaggacaaaaatgagcttggaagtgaactctgagcttcaggtgagaacacggccaaacaacaccttgatttcagcttaaacaaagaatgcagccactccatgccagaattctgacctgtagaaatttgagctaataaatagatgttttaatagcttcatcgatacatacttcacttactgtaaaattcattattttaaagtgtacaattcagtggttttcagtatatccacaaaatgcaaccatcaccactatctgatttcaggatttctttttcttttcttttttttttaatcccataaagaaaatccaaaccaattagcagtctttcttccttctccctgctcccagcccgtgaaaaccactaaattactgtctgtttccatggatatgcctattctggatattttatataaaccaaatcatgcaatatgtggccttttgtatttggctgcttgcacttagcataatgttttcaaaatccatccatgttgtagcatttctcagtatttcattccttgtatagctgaataatataccacacaaatatatcacattttgtttgtccattcatcatttaatagatgcttaggtttttccattttttaagtattataaataatatggcttttaatatttgtgtacaagtttttctgtaggcacaggttttcatttctcatggatataaacctagagtgaaattgctgggtcaaatagtggctctatgtttaacaatttgaggaacagccaaactgttttttgaaatggctgcattattttacaattctgtcaacaatgtatgagggttccaatttcctgacgtccttgtcaacacttgttaatgtctgcttttgtattttaggcaccctagtgggtatgtcataatattgcattgtgattttgatttgcatttccctaatggctaatgttgtacatcttttatatgtgcttattggccatttgtttatgttctttagagaaatgttctgttcaaacactttgcccaagttttaactggactaattatctttttattgttgcgctgcaagaattctacatgtattctggagtagttgtttatccgaaatacaatttgcaaatattttctgtcactgtataggttgtctttttactttcttgatagtgttctttgaagcaaaaaagtttttttattttcttgaaccccagttgatctattgtttcttctttttctgcttgtactttcggttttatagctaagaagccattgcttaaatcaagttcacaaagatttacacctctgttttcttctaagagatttacagctttctttttttttttttttttcttttttgctagagaaaggatctcactgttggccaggctgttctcaaactcctgggctcaaatgatcctcttgcctcagcctcccaaagtgctgggattacaggcatgagccaccacgcccatccaagttttacagctttagatgttgcatttagatctttgatccattttgacttaatttttatatatggtgtgagatagaggttcggctttattcttttgcctgtagatatccagttgtttcaagccacagtgagataccacttcacacctactaggatggctacaataaaaaaaagacaataacaaatattgatgagaatttggagaaatttgaatccttcaatttgctaataagatgtaaattagaggaaccactttagaaaacattttggcagctcctcaaaatgggtatatacctgtaattttatgtttaaaacataactgtaattttatgtttaaaattactgtttgactcaacaattccactcctaggtatataccaaagagaaatgtaaacaaaggtttacacagaaacttgtataaaaatgttaatagcagcattatttataatagccaaaaagtggaaacaagctaaatattcttcgactgacgaatggataaagaaaatgtggtatatctatatgatggactatcactctaccattcaaagaaacaaaatactgaatcatgctacagtatggatgaatttaaaaacattatgctaagtgaaagaagccagacacaaaagtccacatattgtgtgattccatttatatgaaatgttcagaaaaggcaaatctatagagacagaaagcaaattcgtgattgcctagcgtggggtgcagaaaaaagtggggattggagggtgataactcaggggtgcagggtttctttggggggtgatgaaaatgttctaaaattaattatggtgattatggttacacagcgttatgaatatactaaagaccattaaattatatacttaaaatgattgtattatgtggtatatgaattataattcaatagaatagtagtaaaaaaacaggtgatggaaagcatttgcctgcagtctatactttttctactcctggtataggagaacaagaacaaagaagtcactcagattgttttaattgcctttgtactaaggagaaaaataagacctatgtcaggcacatgggtagatggttcctcataaaggcttaagacaaaacccaagtaaataaaaatgagtttgtatttttctgatgaacttttttgtatatgttttatgtgaactcatgtgaggcagaggcagagagtcactatacatgatttc

SEQ ID NO: 759 - DNA, 5314 bp, Homo sapiens
cttttgtgcaggcatctcgctgtctgcgctgggcacggagcggcgcgcgcgcgcccgtctttccctcggcggcccccgcggctcggacccgggccggcagacaggccatccatcatccgccctcctcccgcggagcgccgcagccgccgcggccaatccggcggcaggtggggccgcacctgcgcgacagcccgccgcttccctccgctcccttcgccgcgcctcgcgtgctagcggtgcccttgtgagccactgcgttctccaaggccagaacgggacagatggagaaattgagatgagagctcatccacaagattacccatcaatgagcaccaatagcaaccaaatccactagaagactgggagcttttaagtcaagaaacttacatcagtatcatcattccaagaagcggtatccaagctgttttatcgaaagtgcgcatgggagatggtgctgtgagtggggagtgagtcaaaaactccgctggggtgtacaaaagtctactcaaatgtccacagcatctgtgggggatggagaatagttggaggatctttctccagaatccttctgttctgtagtacaagtattactcattatagactagcacgaaaaatcaagtgaaatgcgaacttaagagtttaaaaagaataaatggtgcttttctggcctattagtaataaattaaataaaaataattttaatttgtaagtaatgaatgctaatctacattgtattaattgggcttaaccagagagtttttgtttacatacattaggcaaacaaacaataggaatgaggatttttaataaagaaggaagccagaaacacacacacacaagcacacacacacacacacacacacacacacacacacacaccaagtaagagaatactaaaagatcagagaaaatgtaattatacttatcaaaatgttttaatgcagtggcctattagtttcagaatataaaatttatttgatttgttgagcaacttggagcttattttttaatcctttcagataataggaacttgaaacatacttggctgtgtataagatatatgtgatattagaaaatcatatatatctgttaatatatattcaaatatattactaagcaaaaatatatttacatgtttatatcaatgatgcaattaataaatgttttcacatcctgtgtctcaatttatccttacataaaacaagtgagttacttattctttaacttctctaggcaaatttcaaatattttctgaatataactacagaatgcttggtttgtgtctctatgaaaggtcttaacacactcctgcaatgaattatatgcatatggctctcccatactgggaatgcctagaggagagaaactgtcttcttaccatatttgtatctatggttcatgcctgctccacatagacccctaggtttcactagagagatctcaagacagtaggtttgaagtaagagaatgggaggatttagaggcatctcgactatactgatatactctgcaatcagcttggcatctgggaaatgttttgctgtctgcttcatctccagtgccttgaacagtacatgtttctctggagcccctgcaaggtttgttgaaggagggcatacatcaggtattccataatttagcaacattccataatgtggctgctagtaaatggttggttcaggatttgaacccaggtcctctgtgtcatgttctaaatgttgggagaataaatccctcccttgtctcagtgaagatttctaagctgccctgggttgttgtgtataggtgtttagcttatgggatgggactggaaggtggtgtagggacacaaaaggaattaaaccatgtaagttcaccttggttggcattttcatttctcctttggatatcaagcctgaacaatgattctcaaagatatgtattaaattcaataaggatttactactactgctcacctattaagtgcgaggaacagttgcacttagtaggaataaagaggtagctggcacaaactattctgcctgttttttgtttttgtttttcgtttgtttgcttgtttgttttttcgacagagtcttgctctgtcgccaggctggagtgcagtggcgcgattttggttcattgcaacctccacttcctgggttcaagagattctcctgcctcagccttccaagcagttgggactacaggcgtgcaccaccatgcccagctagtttttgtatttttagtagagacagggtttcaccatgttggccaggatggtctcaatctcttgacctcaggtgatccgcctgcctcggcctccaaaagtgctggtattacaggcgtgagccaccacgcccggcctattctgcctgtttgttgactgcagtcatagtatgttcttgctcctccctgagctacttttgctttgaataaaaccatggtgtcatggaaagaacaaaaagctccagggtagggcacatgttttcaaacttattacaagagggagcctggatgagagtatcttaatataccttttagagctgatgtgtccttctctccttgagatccaattaaatttactttctgtgagttacatgatagaaagtgttacattgtacattttagcaatttcagcttattcagatcaaacaaaaaaaattagttgatttgactatctacagtttatctctgccaccaaagtaaatagcatggacttgaaggtgccatcccaactattgccctgacattccatcacctgcattttccagaaatcaggtgaacgatatttttcagtcttgctgcatttcacctctggagtgtgtagacccagtcttaatgtgcctaaaccaaatgagatgtgttatcccttccaatggaactaagcactttaagtaactaaggaattggagagagagagagagagagagagagagagagagttttctaaattcagcaagaaaaaataaggtagtcgagttgtgtttcaaaccacttctataattgggagctaaacaaatttgtggagaaagtacttggtcaactgtataatttcttctactattaactatccaaaacaaacaattaattaaaaactaaacacagataatgaagactatctattttctaaaactgtgaactttggaaaggggcgtgctttatggatatctgtaagtccatatttggacaactatcagtttaacttttagtaatctaaaatgctcaacttaaacttcatttcccacttctgccaaaaccagaagaatcaaaaatacagtgaaggggcatgagatttccagctcacatttccaatctccagaggtttgaaaaacttcatctatctatttgaatgccatggttgtgatccaaactgaatttgaactttagatacttaagagtgacccatcactgtttaaaagtccaaagtggccacagagaaccctacggaccattacttcattgtttattcttgtaaattataaatatttttaaaaattccaaattatgaagttcgaaggggatattttatatctctcagccactgtcattttcttcctcccttccttgggtgttggccatgtatctatgagtccagttggtaaaacaatcagtagcattgacaggatgatgtactctggtccgaaactacatttctcagctttttcagttctcaggagacagcggaaaatgtacttagcaaactctattataaaggtccatgttgttccaaatatttagttgtacttaaagtaaaatcatgacttcagatgccaagtgaaataaagcataattttcacactgtatgatggaaagactatttatcatatacatgtctttctcttaggatattattgtgacagtatagcaatataatggtttataattacatatatacacacaatatattttatagtgtaactgcatcattgttctggacaggggtgagatatgaaagtcctaaaagcaaatattgagactattaagttatcagagtctaaactgtgggagtagaagagaaacagaaagaagaaatggaactgtgagatatttcaaagggaaaagacactatatgcatgaagcaaccactattatttattctacaaataagtattcttgccattactttacagataaggaccgtgaggctcaataattagcaaataatggagcatgactcaattctgtaggtatatttgacttaaaaaaatgcatcctactttttcatattcagttcaaaagattaatgatgggacaaagaacaaagaagaatttggtaccaccaactgagggctggtctggtgtggtagttggtagctataataagttagtacaaacatgttctgctcatgctacaagaagccaactggtggagacatcaagaacacagtcagaaataaatatagcaatttaatttaggagagagctgggagctatagattgagcctctacatttaattggtagctaaagtaatgagaactgtatgaaggagaattagagataaaaacttctcaataaaaatagtggtaagaagaagaaatgagaaaacaatcttgaggattgtcaacaccatgaaagtcttagttgtttgattattgttttaatagtagagatggggacattttatgtgtcaaagcagtggtccaaatgagttccgcatctcaagagttttgtagagtgttaatgggtgttactcaaagggaaaaaaaggataaagttataaaccatttaggagaccctaataaaactaaagtgaatgaggttctttactatctttaattggctatatttgtcttacaaatatccaaaatggtgacatggtatatcatagttcctaagattatttgactacagagtccagatttcttggagaatcatctagtggtacaattaattgggagaaaagagccaatgaagagggaaacttggaatgtcagagatggcaggatacccctgatggatcttctgaggggacagcaagggaagaaattaagaaatcagaaagggaggtcttgaggatgagaggtagggccttcagttagaaatcactacatgggccaggaacggtggctcacgcctgtcatcccagcactttaggaggctgaggtgggtggatcacctgaggtcaggagtttgagaccagcctggccaacatgatgagacctcatctctactaaaaatataaaaattagctgggcatggtgtcaggtgcctttaatcccagctacttgggaggctgaggcaagagaattgcttgaacccaggaggtggaggttgcagtgagtcgagattgcaccactgcactccagcctgagcaacaagagagaaacttct

SEQ ID NO: 760 - DNA, 14167 bp, Homo sapiens
agtgctgctggtgccggagtccggaagctgacggcgttgcctaggctggattgcagcggtgcgatcaggactcattgcatcctcaacctccccgactcaagcagtcctcccacctcagcctcctgagtagcaaggctacaggaaaaacaaataatcctcagcactgaagttcaaagccatggttcctgcgtgttccttaacatgacacaggtgggccttcattgaaaacaccttcagctcctccagctcaattctcatgaaaacaaacagcggtgccctttgcccaaggtggaagaggtggccgtgaaatcctcatcagcttcctgtatattgcagaacctcaatcaggccgtgctgcaggggtgaggacctggtcgtccacctggagctcaccaggggaaataggggcagtgtcccgcaggcagtgaactggcacagcacccctgcccctgaccctcgccattgccattgtgatgggggaggggtcagggcccctctgcacagtccaagccacagcaaaatctgggaagtctcctggtctttgcccaggaaacagccttcctagacaggctctgaattattcacctcttccccttcatattacaactgccactcagacgtgaaggtgcagcacaaagcttcagaaacaatggaagaaactgaaatcaggatcctgactcctgcatgggaaagctatagctgtgtgactttgtgcaaatcacacacctgttctgtgtcttgcgtctgcatctgtgaaatgcaggtgaacctagcacttacctttgagggctccttggagaattaaatgaattaattcatacaaaggacttagagagatgtccggcactgagtaaacactcagtgctagctgttatgatgatgattaaagataatcaaagcttgtgctttttaatagacaattttttttggaacagttctagattcactacaaacttgagaggaaggtacagtgatttttcatagcctccctacctccccccatcatcaacatcccccaccagagtgatatgtttgctacaactgatgaacctacattgacataccatcatcactcaaagttcatagtttacattagggttcactcttggtgctgtgcattctatggatttggacaaatgtataatgccaggtacccacaattatagtatcatacaaaatattttcactgccctgaaaattctccatgcttctcttctttatccctccttccccgtagccgcaagcaactactcatctttacaatctccatagtttcgccttttccagaatgttacatagttggaatcacacagcatgtagcctttcagattagcttctttctcttagtaatatgcacgtatgcctcttccatgtcttttcatggcttgatagctcatttatctttagtactgactaatactctgttgtctggatgtaccacagtttatttattcacatactgaagaacatcttggttgcttccaagttttgccagtcatgaagaaatctgctataaacattgtatgcctgtttttgggtagaaagccttattttttattacattaaacatgtaatatatggagtttacctctgccatttcagagtgcccaacacacagcaggattgttacttggttttcaactcctgactcttttccaaatgtctagtgcagatttctgtgcctaggtgggtaacagtgggaacttctgggacccccagctgttggtctgaccttcattcagtatccttctggtcagtcacatctctcatctttgcatttgactctgctcttaatgccaatgaatctaaaaactcagacatagcttgtccctacatctttagtgagtttgttcatgctttcacaatagtcttgaatttcaggaaaaaaagtatatcattcaatgatggcaacataatgctgcagagtttggttacatagaatattctgatgcatgaaaatgatgtgcaaataaaaaagtgataaagatggtcaaagatatacaggaggcactactgatagaaatgagtttaaatttaggaaaaagggcaaatttacttagggaatagaggtgctagaaatctataatgaaattgccacattactcttgagtatacacagattgaaagactgtgaagtggtgattgcaaatgttcagggttttttaattatactttaagttttagggtacatgtgcacacgtgcaggtttgttacatatgtatacatgtgccatgttggtgtgctgcacccattaactcgtcatttacattaggtatatctcctaattctatccctccccctccccccaccccacaacaggccccagtgtgtgatgttccccttcctgtgtccatgtgtcctcattgttcaattcccatctataagtgagaacatgcagtgttcggttttttgtccttgcgatagtttgctgagaatgatggtttccagtttcatccatgtccctacaaaggacatgaactcatccttttttatggctgcatagtatcccattgtgtatatgtgccacattttcttaatccagtctatcattgttggacatttgggttggttccaagtctttgctattgtgaatagtgccacaataagcatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgttccctgactttttaatgatcaccattctaactggtgtgagatggtatctcaatgtggctttgatttgcatttctctgatggccagtgatgatgagcatgttttcatgtcttttggctgcatagatgtcttcttttgtgaagggtctgttcatatcctacacccacttgttgatggggttgtttgtttttttcttataaatttgtttgagttctttgtagattctggatattagccctttgtcagatgagtagattgcacaaattttctcccattctgtaggttgcctgttcactctgatggtagtttcttttgctgttcagaagctctttagtttaattagatcccatttgtcaattttggctttcattgccattgcttttggtgttttagacatgaagtccttgcccatgcctatgtcctgaatgttattgcctaggttttcttctagggtttttatggttttaggtctaacattcaagtctttaatccatcttgaattaatttttgtataaggtgtaaggaagggatccagtttcagctttctacatatggctagccaattttcccagagaccaatgactttcttcacagaattggaaaaaactactttaaagttcatatggaaccaaaaaagagcccttattgccaagtcaatcctaagccaaaagaacaaagctggaggcatcacgctacctggcttcaaactatactacaaggctacagtaaccaaaacagcatggtactggtaccaaaacagagatatagaccaattgaacagaacagagccctcagaaataatgccacatatgtacaactatctgatctttgacaaatctgacaaaaacaagaagtggggaaagcgaatattcagttttgatgaagttgctttaaatgattcgtttggagatgaggctgaatttttaaaaatatccaaacaattttaagcaaaaagagcagaaataaatgcctgaaaattatgtatagaaaaatagaaaaaagtaggacaactttatcacctcaaaccaagagtttaatgagatatataaagctgcattaaaaagctgaaaatttgagaaactgctcacatgatgcaccaaaatttccaggaagaggaaaactagagataagaattttcatttggcacaaattttcctcttgaactacttgttttcaattaaatgatcagttactccctggagtaacaatgatgttagaccccttgaggttgactctagatcattccttgggaaaatggcggtgatcccttctcacatgtgagatgaggccagtcttactggatgggcttcccaacagctttctccttcccttacactgtggccttgggtaggtctcttttgctttaggagctttaatgcctctatctgggcaatgaggaatgaggggatttgaccacatattctttgagggtcttcttcccttttatgagttttcaaacactactgtgcaccatcaatctcaaaacaattacccaagacataattttaaaattattttatttcagtagtttttgagagacaggtggtttctgcttacatggataagttctctagtggtgatttctgagattttagtgcaggcatcacctgagcagtgtacactgtacccaatatgtagtcttttatctctcaccccactcctcaccttccccaccgactcccaaaagtccattatatcactcttatgcctctacattctcatagtttaactcccacttataagtgagaagatatggtatttggttttctattcctgagttacttcacttagaataatggcctccagtttcatccaagttgctgcaaaaggcattattttgttcttttttttatggctgagtagtattccctggtgtacatgtaccacattttattgatccattcattggccattgggcacttaggttggttccatatctttgcaattgcgacttgtgctgctataaatatgcatgcacaggtgtctttttaatataatgacttcttttcttttgggtagatacctagtagtgggattgctggattgaatggtagttctacttttatttccttaaggaatctccatatcattttccatagtggttgtattaatttacattcctaccagcagtgtaaaagtgttcccttttcaccacatcaatcccaacagctatggtttttttgacatcttaattatggccattcttgcaggaataaggtggtatctcattgcggttttaatttgcctttccctgatgattagtgatgttgaacgttttttcatgtttgttggatgttcatatcttcttttgaaaaatgtctatttgtgtcgtttgcccactttttgatgggattattattattattttttctagcttatttgagttccttgtagatttcggatactagtcttttgccaagacatgattttgttagtcacaaagttcctttgccttatttcctccagtcaaggatcatcttaatgatgaactcactaatgcccaagctcaaaagtgacagagaggattctggggaggtacacagagaggcttctgattgtgatcaaaagaggtggcccacatgttgaaaatagcagaaagtttactcatacaataatcccataaattgtaataactcccatcaaaaactgtaaaggttgaactgctcgttatactttcatgcccagccttcagactgccattttctgattgttttacctccacggctgtccttaacatacactgtaaccaatttttactttgaaataatcatataccattgtgtgtgcgtgtgtcctgctatctgtacatctcttgttcaaggcaatgttgaattgtgcttgtttgagtacattaacatttccctctcaaatggacttatttataaagcacaatatgttatgcataggctgaccactttatccctgtcttaaaatgagtgaagtatattgggtgcatggataatgatcacttttaatttttctttttctcctctttatggcagtgtctggcaacattcccctatgattttatattgaatggaataaacatgttgtagggagaaagggaaatttgggatggagggtgatatgagcagttacccactcctttgtgcaaagagaacactatccttgcatcatacattgaacagcagtttaccaatgatgtcaatttattttacaatggcctcaaaatgagtagggattattattcctttgaacatgtgagaaaacagaggccaagaaagttacattaacaggtcaagtatttccaacatatccgtgtatgtaggcatgagcacacactgagtaatttgtcctgaaccaccccttttctaaggaagtccttcctaatgtaatatatcctgaagggcagcttctagggcaaagtaacatgatagtagatggcagtcttccaaggagttactggtttccctaggtctctagttccttgcttatgtgagtattaaggcaaattgagtgggatattgcagcactgggttatcactcacatgctaacttgcgtgggaaaatgtctcccctgcaaagattaattaagaatcagtcctttggaattctgtgctttaaagtgaattactggtggtttctgtgaagttaaagggacagacactgcttttaatggttgttaaatggaaactacagaggagtgtaagtgggcggtacagctgcatttgtaaaaattcaggttgtttttaattaacaccacatgaagcatccagccacagcatattcccccagttcaatgatgtctgtaggtactggaggccagaattcttaaaattgcttccatgttgtgctagatgcagcagtgattgagtactattgctcagggcaattggggtaataggaacctcatcagttagctaaagaggtgtggataggagattggggtaaaaaggtcaaacctggtccaaggctggtttcagagccaggtatccccacctggcagtaaccagggagtaaggatttacccttaacaactcagctggcctcaagccttcaaggcctggaaaaggaaaatgcttctgggttcacatggccaggcaggctggagtctagacacaggagcactgatcattgcttttcctttcacagatgaagaactcaaaaggcacaaggaggttacaccagttgttcaaggcatgggggggtggcccacaatcctgctgctgctgctcttcccttcaggtggatgactcagtcttttccacaaatttaaggtagaaaagggtagtcagttttaatgccatgcagagcagactcactttgcatttatcattgaaaagtaggaggtcaaagaattgacagtagttgaataatcattatacaggcagtcaagcctcactgatttgaatcagtggagtgggactggtctgattataaagatttacaagaaatgcatctcaataaatttaggatgcaattagggtcagataagtatgagataagtgtaggtaaaaaagcatactaagtgagtgtaaaaagtcctccatgctttaaagtttttttttttttttttttttttaactaggtcaagcacaacccatgctagctagtttacactattaatttacttctcaggtagctattgcaaagataaatgtaagcctggattttgcccaacttttcagaaatttggactaggggaatctggaccaggcttgaaatggtgtatgataaaagcaggatttcattagagtgggtcaaaaactagggctctgaaataaagataggcatatgaaattcaattcaaaaatatttaatgacatctactatgtgaaaagcacagggcaaggctgtaaggggtatagagatgaagcatatatagaaagcaacttatacagagtggatataaccctcacatatgcaactgtggttaatgtgcatggtaagaatgggagactgggatgacctgactagccttgggtgcctaaggagatgatggggagccagggaaagtttttgattaggggaacaacatgaccagagctgtggttttctttctgaatattttaagttccagggtacatgtgcagaatgtgcaggtttgttacataggtatacacatgccatggtggtttcctgcacccatcaacccatcatctacattaggtatttctcctaatgctatccctcccctagccccccacccctaaacaggccccagtgtgtgatgttcccctccctgtgtccatgtgttctcattgttcagctcctacttatgagtgagaacatgcggtgtttggttttctgttcttgtgttagtttgctgagaatgatggtttccagcttcatccatgtccctgcaaaggacatgaactcatcctttttatggctgcatagtattccatggtgtatatgtgtcacattttctttatccagtctattattgatgggcatttgtgtggttccaagtctttgccattgtgaacagtgccacagtaaacatgtgtgcatgtgtctttatagtagaatgatttataatcctttgggtatatacccagtaatgggattgctgggtcaaatggtatttctagttctagatccttgagaaatcatcacactgtcttccacaatggttgaactaatttacactcccaccgacagtgtaaaagtgttcctatttctccacatcctctccagcatctgttgtttcctgacttttttttttcttttctttgagatggagttttgctcagttgctcaggctggagtgcagtggcgagatctcggttcactgcaagctctgcctcccaggttcacaccattctcctgcctcggcctcccgagtagctgggtatacaggcgcccgccaccatgcccagctattttttttttttttttgtatttttagtagagacggggtttcactgtgttagccaggatagtctcaatctcctgaccttgtgcattctgcctgccttggcctcccaaagtgctgggattacaggcgtgagccaccacacccggccctcctgactttttaatgatcaccattctaactggcgtgagatggtatctcattgtggttttgacttgtgtttccctaatgaccagtgatgatgagctttttttcatctttgttggctgcatacagaatgggagaaaatttttgcaatctatccatctgacaaagggctaatatccagaatctacaaagaacttaaacaaatttacaagaagaaaacaaccccatcaaaaagtaggtgaaggatataaagagacacttctcaaagaagacatttacacagccagagctgtgttttaagagcagtcacagatgtgagaatctgaacaggcggttaaggaattgctgcattgtttgaatgaaaagcctggtccaagaattataagccatggaagttaactggatgtgaagaaaggaaaaggcctcaaaagaggccctgagactttcagcctgggagatttggcatgatgataagggtcggtcatgtaaccagggaggggactgcattgaagacagttttggctttggacatttgactgtgatccccgtgggttgcacagttggagacatgcagtgcacttggtatatggtcttgactttgatgaagctggatctaaattacaaatttgagaatcagctgcacagaggtaagatatgaatgtgggaattagaggtagagagtgaataaaagcaaagagctggggtctgaacagtgggtaattaatcctatgtttagaaagtggtacatgtggtctgtttattctctgtacctctaactctgactgaggataaaaaagggaccagtgagtttttctgcaacgagttatacgattacgtggtgcagtcaatgactacatttcctctatgctgacagattatctttaaattacaataaaaatgatcctatggtcattcccagtttttgcttttcttttctctgtctgtgctaaatgcactttgggctcttgatttactgttagaaatttcctgtgtagtttggggccgagagtcagggggtcaggttttgggatttgaaacccaaacaaatctttccctgcttcctacagtactctcaaattaatttaggggtcagaggatatcctgtgaaaatatcaagaggaacctagacttttgtttctgcggggatctgaaagaaacgcacatttgaagaaacgcatgaagttcattccagggtagtcaaattctactaatgactgagaacatttatgtaccaactatcagaatcaatttctgaaataaatatgtgaaaagataagcatgcttaactttactgaagaagttacagaagatgagatgcagtacaggaaatccaagaacccagatcaaacattaaaacataaacaaaataagaaaattttattttggcccatccaatttaactaatgtttaccaagtgcctactacactttttgtgctttgaccacaaaaaacataaagcgttaccagaatgtggatgggtactctacaaaattagtcatgatttctgttctcagggagtacactaatgtgtgaacttatatataaataacaacaatagcaaagacaacaataaaccaactgtaatgcaatgtaaagtgaaatcagtggtgagctgagtcaaagaagcacagagtatgaggggtgataccattagttctgactagaggatcaagaaggttttctcgggagaggtggcctttgagcgacatccttgaggatagtaatggcaagcacagtagtaggtggtggtggtgacgatgatgatgatggtgaaaagagcagctgccaatcactaaattcttatgatttacctagctctatattgtttgctgaagaacttctatgttattaatattttaactggtaaagcacaggaaggggatttcagataataaaaagaatggaataaacatgtttgtgtgttggtaggtgtagaacggagagtcatttggtgtgttcaaggtccactgtgcatggtgggttgtagtacaaaataagattgaaagaggagtaggaaccagagcagcaaaaagctgccaatgctttatgaattacacaagtcatacgtagagctctctggttacttgtgtggaaagttgaccccactgagctaagcaggatgggcttgtggtgtgtgcatctgtcctctcaaaccgaatgaaatgctctctggcattgcataatcagcagcaaatcttcctcctcaaggcttatgaagaaaagaccttgaacccagtcttctggtggctctagtaaagacagatttggtgacggcctagaagatttcattaacaaaggatggccaatacattacaatcaaagaaaaagctgggcattgctttctcagatgatatggttcttttccactttaattcacatgattcctaaagcatctggctttcctctattttattttaggaattccatatataactaaaataacctacaagcacctcgacattttgctaacaaaaaaaatactttttattatttttgaaatcaactgattccacagtttaaaacacagtggggaaaaaaaagcctattcatgctgtaggtgtctttatgggaaaaaattcagagaattctgatagctctgaaagagataggaaaacagaaaaataatgaccccagggaaagatattatatttttaaaacaagttgaaatatcttcaagatactaattgtggtctctttctttaaagtatgtggtcatttggggaatagggagggaatgcatgtgtgtggcgggagggtttaatcagcttgataaagctcctcggtttattccagttgggctgagtccagttgagattaggaaggaacagaaaggtttctctatagaacaattagtggggtatgaggaatattcagttgtggtttttagttttcataaatctcaagcaaaatgaagaaataacaatgacaaaataaatacaaccaaacattcaaagactcatatctgcatttttacaagattttggagacagcaaaatcatatttgggactcacttctctggaccctgatatacagtatgcttgctctcaaatgtagaattcagatttcttccaaggtccctgggcattctaggagcaaaggcacattcagatgcagggaccagaccagtttcctaagtttccatgcatccatgagttttggtttatagtgaaaaatgttatctttaaaattccagacatttctaggcaagctgttagcatgaaagttgctgtttcttccctttcgaattcaccttgaagcaagcaacagaatatgcagaaaagaggaaaagaaatctttatcaacatgagtgaatagtaaagggtgtcatccacatgctggacagttgggtatttggttagatgtaatgcaaccagtatatagtggaatgagcaaactgttgtaaaaatactgaaatacttttatactggttgtcatacaggtacttcctggagtgtcttgagtgctctcatgctgtccttgatatccaggtggttacctcctttggaaacccttgagtctccccatggaccagcaaatgacaagataatgcttggcagagtatagtgatatctagagtctgacttcagtattacagttaatgttcattctaattgtccgagctgttaaattatagtttaaatgtcagcactcttgatttgacagctgagatggtgtatgagggaagtattattgttatttagtgtttatcttcccaaaacaatatctgcttctttgtgagaactgctttctgcctacatcaaatatgaagttctgatgggggatgacaaatagctcattattcctttggctacagtaattggttggttcagggatggccctttaactcaagccaggccaataaaataatttgttggtgtatttgttattttttaacaggagctgccactgttaggttacaaaatagaggatactggaattctccacaacaatgatcctaccacatgaaggaatttgtctaaaaataaataaataagtaaaggtatacaccaggagaagcagagttagagattccagggaagtcctcagaatgctgagtacctgggtctagttgtttatacagatcccattctgtccccatcctttctgatcctgttatagtttgatttggatatttgttactttcaataaaaaagtctttacataagaagtaaatgagagggaatcctaggagaccccctgtgaatactccaggtggagagggcactggcctccatagagaggcaacatttgttccccatgagcaatgcaaggaagcacagagcatagttcctggtggaagtggtcacacctacccaagacatggacatgggtcctgtgtcccccatctgtgctgagatggagctttcagctgtaactcagatatgacgtcttctgcttcctgactccatatgctaggtatttgggttggtaatctattgtggggttgtgtgggcttttttttttcctgctttaatatctttaatctgtgtggagtttcttctattagtttctgccagaaagatgcagaccaggttttcacaaatcccaacttaaatcctgaatatggagccaatgtcagataacattgtcaaccttattgtgtgctgggtgctgtaatttgcatgcattgcctcatttaatccatgtaaggattttatgaggtagtactgatattccgactattttacagatggagaaacaggtgaggaaaggccacagagctaaaaagtgctggagtcataactggaaccccagctatctgaccccttatttgtattgttacactatgaataaagtttttaaaatatatatatttttaatagagagtagccccaagaaagcactaaacttctggagcttaattttcggggaagcctccattctaaccttgtccattctgttgcattccccgtgagcatccttaatctagtttgagctgggtttttggctattttcaactttcaaccccaaagtgcttggctaaatagagaatggaaggagactttgaaggcttgcatgaatacttaaggcagagaggtgaacaccagctgcaaggcaaaagaagggagatttcttcctgcgagcggctaggcgaggcaagatggcagacctctgagggccttctgcctgtcaggaggtggctgaaataccctgacagctcagaactgtttgcttgaagtaacttcactgtacgaaaataagaacatttgagaaagtatttgatgagtattccaaactcagtaggggagtagaagcagtgaagtaatgggagcaaattatgtatacatgtgttaaaacattacattatatcccataaataggtgccgttgttatgtgtcaattattaaaagaaaaaaaaaaaacca

SEQ ID NO: 761 - DNA, 1711 bp, Homo sapiens
ctggcctctgtgtgcatgtatgtgtgtttgcatctgtaggtattatttgggattttctatgcataggatcacaccatctgcaaattgagatcattttgttttctgttcaaaaatactttttctcatgtttatttttaaaagataatttggccaggtgtagaattgtaggtgacagtttttctttttttaagttctttattgcaaacttcttgtttgtatgtgaaatcttatgccatccttatatttagtgctctgtatgtaacatgttctttccctttttattccttttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggcgtttaaagttttgatgccgatggtgtttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatcttcaacctccccatttaattaaaatacaattatactaactgctgtaatgtccttttcttctatttccaacatgtctgtcaatttcaactagattattagattcttcattatgtgtcatgttttcctgcttctttggctgcttgatattcttttatttttatttattttttttgcggggggatagagttttgctctcgttgcccaggctggagtgcaatggtgtgatctcagctcactgcaacctccacctcccaggtacacaagcgattctcctgtctcagcctcccaagtagctcagattacaggcatgcaccatcatgcctggctaatttttttgtatttagtagagatggggtttcaccatgttagtcaggctggtcgtgaactcctgacctcaggtgatccatctggctgcttgatattctaagatttgatgctggaactttggtgtcaatgctcaaaatgcccaaagacaccactcaacctcagtgtctatgcacacccaagcttttgcagcaggacaggtagagcagagatgaatgtgctacaacatgctggtagagggtaccaccaattgtgcttggggatttcctattcctcatggaaaaatgtgtcttccttaatttttcccataagaaccaccctacttcatgccctgtctctctgtccaaacaccaggacagtcctctcaccagtctcaaccacccaatggattgacaaaggtgcaaatatgattcagtggagaaggcattctcttgtcaacaaattgtttagaaacaacttttttttacacaatttgtttttttttatccccaaaggaaaaaaattcacctgaacctcaatactaactcaaaaactaactcaaaatggattatgcaactaaatataaactataaaactagaaaaagtatagcagaaaatataagacaaaatcttcatgacacagagttaggcaaagtgttctttattatcaataaacacaaaccattaaagaaaacattgat

SEQ ID NO: 762 - DNA, 2398 bp, Homo sapiens
gtgcccgtcttccctgcgacggttttggggtggaacaggagtggctcctcagggggaaatgaaaggaactgaggagctccagtcgtgagaaggccaatgaagcaggcaccgccagttgggaaatggacctccttggatgctgcattgttttctctggcccagctcctgcttggggcctgatgtacaccctggatggtggctacaggtggggcaccctgtgctgctctgcatctccatccagtcccccatctccacccaaaacagctcagttccccagagaagctccctggaaaccgggaggctgacttcttcaccaactgcagaaccacctgaggccacctggcagaatgcgatccaggactgcacgtggcattccgctgccgtgtctcagtgggatccttccatccagaacggctcctccgtctttctcctcctctcataattttgacagttttaaagcatccaggctatttttgtctttcataaccttgacactcttgaagagtactggccaattattttgtagaatgtcctccaacttgagtttgtctagtgctttctcacaatgagaatgaggttttgtgtttttggtgagaacaccacagaagcaggttatacccttccccatgcattatatcaggaggcacatgtgatattgctgcatcccattactggagacgttaactttgagagatgatgtagcaaagatttctccattgtaaaatcctatttttccttctgaacttaatgagtatcttacaaggagctgtcttggagactatgtaaatatcttgtttatcatcatactttcaccaaccaattttggcattcattggtgattcttgtctgcaatattaattaccactgtgttttccaacagatgatttttctactttcataattccttctccatttattaattgtaattcagtggtaaggaagagctgtcccttctctcccaattacttatgcaattatttcagtatagactcatggatatttagtttattctaccagtgataatccatgaccaacatcatttgtatcattgttccaactgtcccaggtatggccaatgtaagcatcttcaagtcaccccttgtgtttgtttgaaatgcccttattctattttgagcacttcctttctgacataagatgttccaggattattttataatttcactgaccccaccctgtacttaatcatttctccaaagaactctgcttcctttattgagggaatgtatttagaatctaagatctgggtgctggatgtcctcattgttactgaggtgtcactgtgtctagggcctctcagcagacagagctagggaatatgggttaccaactctgaaactattttatgggtattctgagattgagcaaataagtaaatacattgtatttagtgggagggaggcatctcactgtcaaagagagaactacaaataaaaagggaagggcaaagtgaaccctattgtgttagattagaatcagaggcatcagcatgagctcctgatttttagtgtatgtacagattgacagatatagaaataaatatgacctggcaattccattcctaggcatatacctagcagaaatccatggtcataaaaaaaaacatggacaagaatgatcatgctgggagtggtggctcacgcctgtaatcccaacactttgggaggctgaggcaagcagattgcttgagtccaggagtttgagaccagcctgggcaacatggcgaaaccctgtctccactaaaaatacaaaaattagctgggtgtggtggtgcatgcctgtagttccagctacttgagaggctgaggtaggaggatggcttgagcctgggagtcagagactgaagggagccaagattgtaccactgcactccaacctggggaacagagtgagaccctgaagaaagaaagagagaaagagagaaagagaaaagaaagaagaaagaaaggaagaaagaaagaaagaaagaaagagaaagaaagaaaaaaagagagaaagaggaagaaaaaaaaagaatgatcataggatcatagctgcactattatcatagtcctaagctgtaaaccacgcaaattcccgttgacaccagactaaagaatgaatgaccgaccactacatgcaacattatggatgaaaatacaattgcggaaagacattttctcaaaaaatgctgtgtgataccatttatataaagcacaaaccaggcaaattaatccatgtcacaagaactcagtatcaattttctgcaagagaaacgagggggtttctgagctgctggtagtgttctgtcatttggtctgggtgctggttgcattggtgtgtctaattcttaaaatgtatatacattattcatcagtaaaaagttttttaaaatattcat

SEQ ID NO: 763 - DNA, 4521 bp, Homo sapiens
cgcccacagacgtgcggcttgggtgcaaatcctgtttctctgggcagaggccacgcggggacggaggaggcagagaggacgggctgtgatggagaaacgggagaggagccggccaggcgccaccgtcaccaccatcaccaaccaccaccaccatcaccatcactgactgtcgcccatcccagctcccctgcctcacctcccatctcatatccctgtgcagtgccaactttatcagatcatctctttttcactgggtactactttggaaaagcgacagagtgcgccaagtcaggaataagtacatccgctgtgggacatttatcttcccctttctatttagctacctcaattttctcatcaggaaagggggcacaatggcatttcattcctctaaatcacactgagatggctgggttgcttccagtttttccagtcctggcactggacggttatacatgcttggtgatgatgatgataaagtaatgtcttcattaaattggacagttgggagttttcagacttactcttctttgacttctgagtgtcagtataccagtagcaaatagaaacataaggaaagtgaaactttggctaacataataccaagaatagatgcaaaacaggcacttttgtagggacatcacccaagagacctgcaggcaatggtattcatctgcagtgtagaaagcaccccatcagtgccaagtggctgtgggagctcctcaatctggatgcacagtttcccgtggggttttcaccctacctaaagaatgctttaattgctgtttttcaaaattgtctttcaccaggccccagggacggctgaccattcagaacaaacacagggacagagccccagggctgttgggaagcccagcaccagagggcatgaaccttcttaggagaagtaaaacttacaaaaaacaagctcttaaaccctccgccttttcccctattggttagaaagtgaatcttaaactgtgttttatgttctagtctaataaaagacagctagacaagcctacgtttcttgacatgcttggaaaatcatcttcccgaaaagtcatgcagcagggctttttttttttttttttcgactgagtctcactctgcctctcaggctggagtggagtggcatgatctcagctcagtgcaacctctgcctcccgggttcaagtgattctcctgcctcagcctcccgagtagctgggattacaggcgtgggccaccatgcttggctaatttttgtatttttagtagagacagggttttaccatgttggccaggctggtctcgaactcctaacctcaggtgatccgcccgcctcggcctcccgaagagttgggattacaggcgtaagccaccacgcccagccagggctcctttttaatagggctatggagtcccccacctggtggtttttttgccctgtgccctgtttttacaattcaagaaggaaagtgatcatattaaaaataatgtgaacccagctgagctgcatttgtcgttaccatagtttaagatttctcaaatgttgaagtataattatatgtcattaactcaaacctctctaatttgtgaagtagggttttaaatagggtatgtaattctgtggagaatgactccgaaatcattctgaggacctgaagtttaagtaaggcatagtcagtctaaaacaatgacattgtcagaacgaagacttaaagaattatttagctatgtttttaattctggatctttaggaaataattagcatctcaaggaagcttcatgccaatgatagtgtcttagtcttttgggtctgctatcacaaaatgccttagactgggtgattctgaacaagagaaaggtattgctcacagttcttgagtctggcaagtcgtggatccaggtgctgtggattcagtgtctggtgagggctagctctctgcttcatagatggcaccttctatgtgtcctcacatggtacatggggcacacaggctcccttgggcctcttttataagggcactaatcccattcatgacatggggcgttcagaagctaatctcctaaagtcccacctcttgatactgttgccttggggattaggtttcaacgtatgaatctgtggggacaccaacattcagactgtgacaggttggcattgagtaccaagttatatccaacacgcattgttttagcccatacaaattgttatagcctatactaattctatgttaatttaggaacaattcatttgcttttgttgagatatgatttacatacataaaatgcacaactcttcagtggacagcttgatgaatttttgcctatgtgccccctgcaataagatacagcctatttccacaggcctaagggatcccctgatgccctttctagtcagtacccccccaacagagccactatcccttcaatggagccactattggacttctatcaacatagaaaaataatttcttttaaaataatttctaagtaatttattttgcacttcactccattaaatgcaattggcctattccttaaatgcatttggcctattccatttatgaccaaatctgggggccctgagcccagtgctgtgtagacatgagactgtgtagacctgagacatggtattattaatacataaggcaaaaacttccacaagcagaagcaataccctgtatgcagatacagagggttaggggaacccacaagagtctgggtctaacccagttttgttttgtttgtggggggaaagggaaggctttttggaggatgtgaattttaagttgaaaatggaaaactgagtagaagtgatccagctaaaacgtggtaggaggaaaatgaaagcctattctaggtggaaggaacatcttgaattccagcctcagaaataagacagcatggagtgtttgaagagcaaagctaagctgaagatgcttggagtatagggctgtgggagaaaagtgggaaataatgctggaaaggccatagggaccctttcagtttgacacaaaggccctgctgaggggtggggcttggctgtaagagctaggagagctctaggacaggcttgcgtggtgggcatggcaggaggagacttgaggactcagcaggcggccttagggtcgggagattacaggaggcgcaggtggggggccaagtggtcattcaggtaagagacagtggtgacctggactatgcagtggcaacaggaatggggagaaatgaatgaaatggaaagagaattacaaggtaaaatgaacacaaattgatgtttgctaggtgagaattcaaggatagcccttaggtttcttggatcttacaaaatggatggataatggtactcttggagagatgagagaagaatcttgtatatattatatgctcctttggtatgtttctttctgtgtggacttagtttcggttgcaagttagtgtgatgcattcaggtagaaatatctactggggagttgtaactcatactgactgagcacactccatatgccaggcatgctccgtcacttaggatgcagttgtgaacaagacgatgaaaaccctgcctttgtgaaacacaggtgggagctgcagcctggggacccacaaggtttaagtggtgacagaaggcttcagagtgaatgagatggctcagtcagatttcagtgaaagagcagcagcccaggataaaatctcaagaacgctaagagactaagaaggaacaaaggagagatggcaaggaaagcaagagaagttgggcttcacaggcctagggagtgatccctagtgtcatacacaactgtgaagttaagggagatgaggactagagatgatctactgcagtgcttctcaaagtggggtccccagaccagcagcagcagcaccaggagcttgttgcaattgcagtttcttgagatctactccagacctggtgactctgggagctctgagggaagggcctagcaatctatgttttaacaaggtttcccagtgatcctgatgcatgctaatgtttgagcaccacagctctattgtgttaattgataagtcactggtgatgcagcaacttggtgaaaataacttcataaaatttacaccctgtttgggcaaattttaaaaatgtttcgtgggactgttaaagttttattctatttgtttagaaatttcaaatgttttattttcttttgcaataaaaatgttgttattttcttttgtacagtttgggtttttttcccctctttgattattcattgacagttgatccatatttttttcccatctgttcagatttttgaagtttcattcctatctcctttgaaacacatcactttacagggtctcaacatgttagggcacctgcatcattgatattggttcattgcccaaaacagagtgcaatcataaagataagtgagtctcaactctgaatggcagcctgagaaaacacctagatggttaattcagctcttccaaaaagttccaagaccctattagggatatatttctaattatttgagcttgttactcatgagaagt

SEQ ID NO: 764 - DNA, 9836 bp, Homo sapiens
agtccccaggagaggctggtgcaggaaggctcagacactgtgttctctgacataatttataggcccatggcatatgtggggaactgagaggtctttggtcaacagtcactggggacctgggtcccgccaacaaccacatgattcattttggaagcagatcctcccctacatgagccttcagatgatcacagccacatatgacagcttgatggcaacctcatgagagagacagaactgaaaccaccctgattcctgacccacagaaattggcttctatgaggctgtcttgtaggatgcccatgacgatcctccagacactaagatgagaaaactaaggcccaaagggacacctggctttcctaagacctgtaagtggaagagtcagcatttgaatggagaactcgcagctttcggagtctagacttgttttacctcaccagactgcttctactcctagtgattccttcccttagattaagccttgctctcttcccgtgcaatcatgaagaggattatattagtaaatccctgaacattccctgattggggagtgagggtcaaaccaaggcaaatggcaggattgacactcacatcaagggctggctcattaagggctcgggacctggcgatcgagttgcattgcagattttggaagtatgcaagaccacgccagccacctttccagggagagaccatgcaaagaaggcaggtgatccaagggctgggagtggtgaggactgctccagcccctgagcagctgtcatcccagcacaaagtgtcagaagagacctcaaagtgtggtctgcagacgaggcagcatctgcatcacctgggagcttgttagaaatgcagaatcttctgagagaaccagacctgctgcatcaaaatctgcattttaacaagattgtaacttagatacacagtaacacttaaaaaggatggggcagagaggctaagtcagcagcttctcatcacactccaatctgatgctgctagtgctccaaaaagctctcatatcctcactgactagcctagggctgtgtctatcaatgcattatatgacacagatgaagactattgtgtaccttcctcaatttttaccccattgtttcagccttttgtacatctttaatgcaaacatccatgcgagaattcttgtgacattaattttttggaacaacctgttttgcagagcaaatttcattaagccattttaatccagagtttaattttttatacagctcgactcaatcatttccattttttttccattagaatgtctatttgtagtaacattattttcatgggatcaattattttctgtttaaatttacaacaggcatttgactcatcagtctctttttatataccatctttttgctgattctgacttctgctatttggagaggttttcttgtttgtgtgtttgattcttttgtggccattctttctattaagtgaaaatcgtctggatcaaattttgtagatttaaattttgttattagtgatacctgttttttttccctgtcaattttagctcattacacattctagtcattttaaccctgctagttttgttagttgctgatcacttttaccataccagtaatacgtggtagaaataatcaccagaatgaaaactctgcaaaggcaggatttctgtccctttttttttttgtttttttttttttcctgccttatacttgagacttagtgcatggcacatagaaagtgctccatatggccaggcgcagtgactcacgcctgtaatccttgcactttgggaagccaaggcaggtggatcacttgaggtcaggagtttgagaccagcctggccaacatggtgaaaccccgtctgtactaaaaatacaaaacattagccaggcatggtggcgggcacctgtagtcccagctactcgggaggctgaggcagagaatcacttgaacccaggaggcagaggttgtggtgaggtgaagtcacaccactgcactccagcctgggtgacagagcgaaactccatttaaaaaaaaaagaaagaaagtactccataaatatttgtaggtggaaagaatgatattcacatatgatttaatcaaagactgacagtttatctatttgataaaaagactgtgagaagcagagattgatggagacaggagagaaagtggaggagaagagaagatggagacagcacacacacatgcacagacttgaacatgcagacacacattgcacatgcacatgcatgcacacagccacacacgtatacacaaacacacatgcgtgcacacagccacacgtatacacaaacacatgcgtgcacacaccacacacatatatgtaagcacacatgcatgcacacaggcatacacatatacataaacacgcatgcacacagccacacacatatacacacaagcatgcacatacacagaggcatatatacacatgcactaacatacgcatagtcacagatacacctgtaggtgcaaacacctatatatgtgttcacattcatacacgggagttattatatttgtgctcacacatgtagagggtagaattgtggttattagatgctgggaagagtagaggaagagaagatagggagaggctggttggtggatacaaagttacagctgaatgagagataattttgactgttctgtatactgtaggatgaatatggttaacaataacttagtgtatattttcaaaaagccagaagagaggatcttgaatgttcacagcacaaataaatgataaatgtttgaggtgatggatatgctactctgatttgatcattacacattgtataaatgtattgaaaaatcactctgtatcccataaatatgtataattattatgcatcaactaaaaattaaagaccacacatatatgcacacatagacatgcacatgaacacacatactcatgcatatgtgtatacatgcagagttacacatatacacaaacacacatatatgcacacatagacatgcacatgaacacacagacatactcatgcatatgcgtatacatgcacagttacacatacacacacatatatgcacacatagacatgcacatgaagacactatgcacatgtccacacatgcacacagccacacacatacatatatacacaaatacccataaatatgcacatgtagacagcatgcacacagagatacatatgcacacacacagccacatgtatacacacttgtgcaaatgtatgcacacacagacacacatatgcccatacataggcatatacacgtacagattcagatataaacacatacaaacactcatgtacatatgcaaacacatgtacacacacagtctgctggcatagtgatggctaaaccaatgcagggtagggtaaaatgtctctggtgcaaggtcagtaggataaaatctgcaggatcaaatggaatgcttaacaacactcctctgtggggtatcagtgtctccattttacaaccagtgcttaatcaaatgcacattgagttgaactgaatattggaaaatgaattgctacctttgaatgaatctactgaaaaattatacttgtcctgggtcagaccgtgtgaaaagcactgggtattggagatgaaaagtggttggccctttttctttgaaagcttagtccagtggggaagatggatgtggaagctgagcaattaaaatgcagcttgataaaagctgtgctgaaaaaccctcactgagctgagcagtgggggctgggagggagcaggtcttaaactgaatgatcaggtttagtgggagctgtttaaattctgagccatcaggcatttttgctggattcctttcggtgcgcttgttaatcaattataaaataataataatgaacacttcaggagagaggatggaggttgaaagacagtggagggctggacttgaggttggaagatttgcagagacctggattgtgcattcgacctttacaaattgaagcgagaggctttgcatctctgaacatcaggattccactctataaaaaggagaatgaaagcattcagtttataggtttgctgtgagggctcaacgagaatgtggatccaaaaaagctttggaaaccaaaataccgctagttagcttgctgctttattatccaaaagaggctgcaaagatttgaggtttgtttgtagtttgtttgtagattagtcagtgtctactaaaataacactgtgtaacaaccatgcccaaatcttggtggcttaataccttaaacgttatttttctcattcatgaggctgtaggtgggttggaatttggcagatgtaggctggaattagctggacctgcctccaggaccagggttggacccaagtcttctgtacgtgtcaccttcttttggtgccagtgctacctgggattttaatttcatggttttgcagaagcgtaagagggcatgccaaccacgtgaacacttttaaagcctaacatcctataggccaaagccagccacaggtccaaactcaacttcaataggcagggaaagtcctccacctactttaccaggggagtactgcagagcaatgaccgaggaaggaaatgtttaatcctattagggagggagggggggaccaggaacacaaatccctcaaggcaggacgagtaatggttggctgcccaaggttgacagactgggtctcagttcctggcactgctcctctctagccatgagactttaggcaagtcaacatttcagagcctcagtttcctcatctgtaaagtgggtataataatagaattctcacagaatttcagtgaggattgcctgattcatgacaacagccttataagtggtccccttcttttacctcgcatcttctgtaatctcttctctatgcttcatcctttaaatacaaaagtcacccgtaaagacagaaaacagattagtggtggccagaggtggtggagggagagagggggagaaatgagagaagtgctaaggggtatgaggtttccttttggggcgatgaaaatgttctaaaatcgatgtggttatggttgtacaactgcaaatatacaatccctctgcctggaaccttttccccaagaaatctgcccccaccgtaaatcctcacttgcatactgtataatgaggcttttctggaccaccctatttaattacccactcctttctgtccatgcctctctctcgatatattttctctgaatgtttgtagcaacttgacatattttgcatgcttatacactatgtactttatattaaagcacagttatgtaatttatttctctggtcctttcacctcctttcctccctccctgaaatatgccagtagaatgtaaccttcaggaaggcaaggatatttaccttctgggtttgctgctgtctccctagacagctcctggcacacagtaagccttttaaaaatatttgttgaatgcatgatataagccatataatgcttagtaggtgctcagggctgaggaacataattgatgttagcttttattatctttatttacttcaaataacctacttaattgggaaattttccgggtctggagggactctgagtttgagtccagtatcttccctgggagtccttgcttgcacaaatgtgtgggatagactcccgctgtgtctgtggactcaacgtctcagctccaggctctttgctgccaggcatagtgagccgtgacatttataaatctctgggctcttaatcccctgctgatcctcggagaggagtagacatttgttgctaaacacattgccccactttgaacaaagaaacgaagagataccccaagcatcaatacaacagctgcctgcgatggctgtgacgtcccttctatcctaaggaggagggtactgggactcagtcctgtgcactgacctgccccactcacctggctggtgaggggtgcagttactacctttggaacacatatcattgggtttttgtattgcattcttctgtctctgagcagatctgtttgtttaatggtctcttcctcacattcagctcaagcctgtaaatccttcgtataaattctgcctgctccttgataccaatctgttctcctccaagtaaatcttttaaagacaatactccagcagcaccgggagaacatttcctgcaaaatcatgcccggaagcccctgttagcatgcaaatatgcccctttgcagcatgttctgattgtaactcgtgatgcacagtgcagagaattaagccgggtcccttcctcatcagtcaccatttaatggagactgaatggttgtggatacttttgttagggtcatcaagaaggtttgccatgcttggcttggtaaggaggaggttgtgtgctcctgtaagacaaacctagcactttataggctcccaaaagcccatggtagttacaggagccatgaaaaacaaacatgtagacattcagtagtggtctcaggaacccctattggcaaactcaccatttatggaaagacctggagggcagtgtctttggccatgacatgaaacagcccagtaagctgcaaaggccagattgaagagagctgttgaaaattcatttgcttgctataggctggctttttatttcattttattttatttgtttatttattatgttttttagcaaaccatctgaaatgggatgagagagccatatttgggcataccacctattggaccagcagttctacagaggcgagggtccattttttgttttgcagaagcctctctgtcagcagttctcaaaaggaaaggagtttatttatcttcagttcagcaaaatttactaagtgctgacaatgggctaaggggatagagacgaagaaggagattcttgccctccagaaatttacagcccaacataatgtaaacacttttctatacaacacttgcaaatagtaattgtgtggaaattcaaatggtggacttacatgttatcagactctgtgtgtgtgcatatgtgcatgtgtgtgtaggtcactccctaaagaatgacaaatatgctaagattttagttactccttgctttttttgtcccccctcctcgttttttaacctttattgaagtatcattcacataccgcagactgcaaccacttcaagtgtaaagctcagtgactattaatatatttacagagttgtgcaaccataactgcaatcttattttaagtaatttctacctccccagaaagaagccttgtgcccatttgaagtccctctccttcctaaccccagcctgaggcaactactaatctattttctgtctccatggattttccttttctgcacattttatgtaatgaaatcatgccatatgtgggtttttgtgcctggtttctttcacttagcataatgttttttgcagtttatccattagacacactcggaagcagtatttccagtatcagtctatgctctcattttgtccttttccttttacaattgaaggcgcaattaactggcctaaattcgatgaagttaaaggttggccatttgtggcgtgcttactcaattcaatctcggctgagatttgatcccttattattacattagtgctttttacttttctgttttcagttactttttataaaatagtaagagtggaagataatgaaacggctaaataaatcttatcgagagatagtgaaggtgctggagcttcctcactgagcaaacagaactacagtaaaatgataactcatgaaaaaattaaagttggacatatgcattggatttaggggcaccagcgcacaatgtgtgaaagtgcagcttgctcaaaacttgaaggtgtgaatgtcagagactacctgtgaatctcgtcatcattgtcatcattctcataacgataatagcaattcccttttctgagtgcatggtatgtgctattcagttcccacacatttcctcattgaatcctcacaactgctattggaggaatatattatttttattattattttcattttacagatggagacaatgagtcccagtaaatttaaagacacatgcctaagactgagaacccaaaatatctgagacaggtctcagtcaatttagaaacgtttattttgccaaggttaaggacgtggtcggcacatagcccagggaggtcccgatgacatgtgcccaaggtgggcagggcacagcttggttttatacattttagggacacatgagacattaatccatatgtgtaagaagtacattggttcagtccaacgtggaacaactccaggtagggaggggcttccaggtcatggatagacaagagacaaaaggttgcattcttttgagtccttgatcagccgtccactgaacacagtgttcattcctgggcataggccgaactaactttgggaaggaattcagttcatggtttgactctgaaacaaaattgataataaccctttcccaaaaagaccctcttcttgctcggggaccagtctgcctttgcaagactaacaagttagctacaagattagaaattacagtttaggggtcatgcagcctctggctccaagagtctgaacctcctcaaattgctcctggggataacatcactattgtaaaacctaagatcagtgcttgagatattttgcagaccgtgcactccatggatcagctgacaccatgcagaccagtaatctggctcaatcagttctgccgtctcatccaggaacagcaagaaaacctcacttcaaccccctaggactccatctccaacctgaccaatcagcactcctcacttcccgagcccataccccccaaatccccgaatgcttggggagactgatttgagtaataataattaaactcctgtctcccgcacagctggctctgtgtgaattactctttctctattgcaattccccttccttgataaattggctctgtctagacagtgggcaaagtgaacctgttgggcagttagaaaaggagcctgagagatgggttgagggcgggtagagaaagtaatgactgtgatcagaccccgctgagagatttgccattgtcatgaaggtaagagggagacgttgaggaattttaagtgcagatgtgatgtgaacagatttgagttttacaaaagtgaattcctggtggtaataacggtgccttggatcaaagttctcaattccaagtagcaggtgagcatctcagaaaagatacaaagcttcggaccaaggtttcctctcttctcttcagcaggaatcacagtttggggaactaaacttgccaaggagaacttcaggtttctagaatccgaggctgatgaagaaagaatgttggggcagattttgacaggggtctaagctttgcctaatcacactgcccgaatgagcagccactgctgatgaattctcattttcttaactggcaaagccttcttggcacaaaaaaagtgtttatggtttttcttaaaaaagcgtttagtgcctctgagttgagaaggctggtgtactgagatgtggcatctcttttcttgtaaaagttaaggggcttttttcagtcactttatagtttgttttattgatggagaaagggaaagtgataaaatattcttgtcttctaaaatttctgtcctttggcaacaaggatgagaaggtatatgtcccggtaaatttttgggttacaaaataatcccttctcttagtgctctactgactgagttaccacagtgcttcccatacactgtcgcctcaggcaagttgtttaatttttccaggcctcagttgcttagtctgtgaaatgggaatatgaacaccaataccacctacttcttagaagtattatgaggattaggtatctaatatttgtaaa

SEQ ID NO: 765 - DNA, 2300 bp, Homo sapiens
cacagactatccatacccatgagattttctggcttagaatcattccattggtctattaaatctgttttcttgcttgaggcagtatctttgagaaggcgattctattttagtcctcatacattatacatgataagtataaaaggaattcatttttttctgatagaaaagagacttttacctttagaaacgagaatcataacttaagttgtggtaaaaaacaaaaactcaacttgtcttatttaaatgcttttgggtttaattgtggaagacagtgtggcgattccccaaggatctagaactagaaataccatttgacccagtcatcccattactgggtatatacccaaaggaatataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaatgatgagttcatgtcctttgtagggacatgaatgaagctggaaaccatcattctcagcaaactattgcaaggacagaaaacgaaacactgcatgttctcactcataggtgggaattgaacaatgagaacacttggacacaggaaggggaacatcacacaccagggcctgttgtggggtggggggaggggggagggatagcattaggagatagacctaatataaatgacaagttaaggggtgcagcacaccaacatgacacatgtatacatatgtaacaaacctgtacgttgtgcacatgtaccctagaacttaaagtataaataataaaaataaaataaaataaatgcttttgggtttaagtgaatgaagtcatgaagaaagtgagtaaaaatctactgctagcacctagcagtaattcaactttgtgaatttaagaaaagcaccctcttcgggcaaattgacaaaaggtgaccctactggacatgacaatggacataggcaactctcagatgaattagaaaagagtgccccttcctatgagctgccagagctagagacctggccccaggagtggaggcagaattcagccccaccccttccttcctcctcaaactcattatctcatggcaggggcccaaataacacattttatccccctgtgcaaaacaaagtctatttcttagaattcagccttcttagaaggtcaataatgggaaatgcagggctgtgtaaataattacatcttcttcctaccataacatcataactagcacaattataaaagacagataggaaaataataatagtcatgaaaatgataataatgtactttgaagaggaggaacaggtaaggaatggcatcaaaggctggaggctgagtaaacttcataaggaaaagttcttggctgatggccacccagcttcaatattctgccagggtgccacttgcataatttaagagaactgatccttttccctcacctctattgccacttgtccacacatttataataatagattacacctgggcagagcttgtattgtacagtgccaagtactgtatatatatactcacatcaactgtgaagctgctctctccactttacagacaaggaaagtgagacagagagaggttaaataaacagcccaagattgtagctgatgtattaatccacagctaaatgggtctccttaaagatctggaaagctgctgacaagaagcaccgtcaaagatgaggtcaaaaaggaaactccttttcagtgatccagtacaggacattctttttaggcatggaaccctgggatctgtcataagttatgaaactttgaacaaaccattccacttccacttcctcatctttgaaaggaaggcattggatggcatgttcacttccagctctaaaatgctgttcctctaatttacatgcaaaatagcatgtagacagcctttagggccatctgaatgtaaataccacatctacctttttgaagccatggggcctagctaaaactcaatttactcatctataaaatgagaataataataatatctaccccttagggttattgagaatattaaataagagaataaatgttaaagcctttagcatatcatttagctttggctatgtgactagtacatagtaagtgttcaagaaattttcctttatcactatcatcatcatcatcatcaccctgtgtgtaggtgctacttgcgaaggtgctccaattttaattccctgcagatgcaataaagagttggcaaattcccagctgggcgcggtggc

SEQ ID NO: 766 - DNA, 1772 bp, Homo sapiens
ctctggaccagacgccgcctgcacgggtggggacgctggtcgctgccgggggcaagtctgccgactccagaaagaaaggcgaaagaatgtgtgtagacccgggcatccttggtcgtcagcatgtttgctttatttaattacagatgttcaggctgctgtcaacacccgacaattttttttggtcatttcattccctagagattgtgaagctaagtgctgtgagggaaaccagaggcagctgagatgtcgtggaagtaacagcgaatgaagccaggatgctggattctgaccttggaactgttctgagtaaatcacttttctcagtaaatcttctggagttgtttccttatctgtaaaatgggataacgatgtttcccttacaatttaatggaggagttaatataactaatagaatgtctgagaaaagcctttgtgaactgtaacgcatcctgcaaatgcttaatattcccttataaaaacgagaggcttggttaacatgatctccagaattttagcttagctctacattcagtgtttctgtgaatgagttcaggtccttacttccaaggaatttgtaatctacagtggttggaggaatataacatacagactagtcactaaaattcaaagcagtgtaataactgtataaatgaaaagctataaatgcttagagacaggagaaatttgatgggggaggatctgtgaggaagatgaatttttaacctaggatttaaagaatgtgtagattcccaacaggctaaaagatggagagaggatggataaaagtaaatgaaacaattacatgttttttcattgtcaagttggcagagatgaaaaagttcaacagcctttggttggtcaagatttggaaaaacaggctgggtgcaatggcttatgcctgtaatcctagcgctttgggaggccgaggcaggaggattgcttgaggccaggagttcaagaccaacctgggtcttgctatcaagaccccatctctgtttttaaaaatataaagagatttggaaaaatggacactcaaagtcaatattggtaagagtataattggtacaaacctttaggaggacaatttgacagttactaaaatgtacataatctagttctggcccagtaatccactatgaggaatttatcgtacagatctgtgcaagtatgcaaagaaaaatgtacaaggatgtttactgcaatactgctttttttttttttttttttgagacagtctcgctctgtcgcccaggctggagtgcagtggcgcaatctcagctcactgcaacctccgcctcccgtgttcaagcgattctcctgcctcagcctcctgagtagctgggactacaggcacgtgccatcacacctggctaattttttgtagttttagtagagacggagttgcactgtgttagccaggctggtcttgatctgctgacctcgtgatcctcccgcctgggcctcccaaagtgctgggattacaggcgtgagccactgcacccggctttttttttttttttttctgacagagtctctctcatgtcacccgggctgtagtgcaatggcgtgatcttggctcactgcaacctccatctcccgggttcaagcaattctcctgcctcaggctcccaagtagctgggattacaggcacctgccaccacgcccggctaattattttttattgtatttttaacagagatggggtttcaccatgttggtcaagctggtttcaaactcctgacttcaggtcatccacctgcctcagcctccc

SEQ ID NO: 767 - DNA, 3602 bp, Homo sapiens
acacgccgggcgccctgcgctccgagcgctgagaaagaaatccgccccgagatgcacctgcagccccgcgcccatccgtgcgtggctgcggctgtgcgtgcccgcgaacggggaccagcggccgccgagtccgtccacatcgccaggccaggagtcagaacaaggacgggcctgtgatgtgtctgtctatgacgaggaggacaatgtcctaaggaatggagaggaagaaagtgaagggaaccaggtccctggattccatgtggaacagtagcccaggatgtgcactatggactgttacaagagagagacatgatcttccttaaggcattgatttgtcatgagtctctttgttatagccacttaacgttaccttaatacacccacttcatggataagtaaaactgaggcttggagaagcccacattgacacagcaaagaaggctggggctcttgtgctggttaaatggaccttgatgtcttccaaatgttttcatgctggattctgagccactctcctggctgcaactctgaggccgggcagactttccgctggaaagagaactcaaatactggtcctggggacaggaggaggcagtgctggggtcttctcacctgagccgcagaaagaggacaaaggccaccaggagggccaccagggagatacagtggcccaggtagttgatgatgactgcgacatggtagtgcaccttgctttttttctggagcaggagagaggggcagagagccaccaaggagctactggccaccaaggagctactccataggccttcctgttggaattacagaacccacttgaaaccagagatcaagtccagccctatccaccaggcatcccaggagaagccaagaccctatgcccagttccgcccggccaccaaggcccttctgaaggagcaccctcattggggaacctctccagaggctgctacagaagctctgttcttggagctggtttccaggcagaggctttctggaacatggcagctgcccttggagactgctcctctcatcccagttctttccgtagaagagactgaataattggccacgccacgcagccggtatctggaacctgggtctgcctggctttaagctccctcttttccctgtttcccagggacatttctttttttgggtgggggagggatggagtctcactctgtcgcccagtctggagtggtgcagtggcaggatctcagctcactgcagcctctgcttcctgggttcaagtgattctcctgcctcagcctcccgagtagctgggatcacaggcatgcaccaccatgcccagctaatattttgtattttttggtagagatggggttttgccatgttgcccaggctggtctcgaactcctgagctcaggcaatccacctgtctcggcctcccaaagtgctgggattacaggcgtgagccaccgtgtccggccccctgcgacatttcttgggggacaagcaggaattgaaagcagaggcactctctggggtggtctcacgccactttgggcccaggagcctcgggggacctcctgctgggacaatagcgcccaagagggctttcctccaagagcctgagggagaatcaggccaaaccattcccgggggacaaagtctcagtgtgcctccctgagcagtcgggcctgggccgggttcaagccctgtctctcatcggccacatcagcatcatgcaacctgagaagacagctggagagacagcctgagggatggctgctgataccctgagacaaatacatcctgcgacacccagacagaagccagtgacactgtgacatttccaataacaaccagagttctggccagcattatttagagagacagcaaggccttaagaggcacccaggaacaccctgagaggtggccagtgatacctggagaggagagtcagcagcacccccagggacagccagtgacaccccgaccgatggccacgataacagcaaagcagctgggatgtccgaaggacaaatgggcacagctacccctcgggccctgaccagcactccatctccatccagtctggagacctaagaccagcaggcaccccgccctaaggagggtggcacagcgtggtacttggcagaggccactccgctgtaccctcagtgatctgaattgaataagcaatttgtgcccggctgactctgactggactctctgcaggacaccacctcgtcccaggcgctgcagtgccagatccgtcctgatgcctctctgggttggtggcaatgagacctcccttccaagctccccactggtgcccactccattctggcacgtcctctccaccgaggcttccagagctactcctcttaccctgcagtgggcactcactccagcccctcgatcctcaaagggtggcccctggcccagcaacagcacgcagaggagcacgcagagatcttgaggaaagtggaatgtatgccctacgccaggcccatggaatcggagcttggttttaggaaaaagcacctctgcagttcagaagccctggtccaaccaccactcacctctccccacacgctagcactgatgctcagcttgggagagtccccagagcccccaggggtcagggaccgcactggccttcggcagagccacagctggacagccatccttcaacacggtccctcgcccttctgctgagccccaaggcagtcctgtcactggctgtgtggctttcggtgagtcacctgactcctctgagactcaacatcctcatctgtgaagtgggggcaatgtggtctttcttacccacttcactgggagatggaccatttgtggggaaccaggagacctgcatctgcaatataaagtccctacaagcatcggcagggtcatcagcccagcttggctgttctgggccccagaatgcacctccactgcagagggctggcctggagcagctttcctgatgtcccttccgggccctgggggaggccccgcaggctggacctggcctctcctcatcttccgccaggtccttctgccttctcaggaagccttgctttgggaaggagtttttccatttaaaaggctgcctgcggagggcctcagacactgggttgagatggatccagtcggcctggagcaccatggcaggttcctgagcagtgaattatcccagcttgtcaccctcatcatcccagcgagacagccgacagtcacctgttccacggaggcggttcagcaggtcagagtgaaaccaggccttgttgccttccctggcctgggagactctggcggaccctgactcggggcccagagaagcccttgactctccagtgtggccaagatcgaagatgtacctggtgaccccagaggcaagggccccagcccacactttccatctgctggccaaggtcctgggtcctggggtcctgcaggctccacaatcccaatatccgacccttctgactctgctttgctttgcactgtgttcaggtggagcctattttaagcaaaggcaagagaagaaaatctaaacgcgaaaaagaaatgaggtcataaatgaagatttctgtaaaaagctgggtccgccgttgcatttaaatactgggatc

SEQ ID NO: 768 - DNA, 10783 bp, Homo sapiens
gcacttgcacaacagggaaacaggagtgtcatcaaaagtaaattccagccgagacattctctcctatatgagaagcaaaagtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggcaggttatatcctagagatccagaagagccacagctgcacacctctagggctgccagtagagggaagaggagggccattgagaaatcaggatgcttttggcctggttgagctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttgctcctagaatatttgggtgaaggagtatatgctgtcagtggtgacctcctcttcttctgacccatgccctaggtatcaaagtctcaacagccctagaacgctgataacaaaggtttgttttgtctaagtaggtaaaggaattatccaattgtaatcattttatcttcagtagttaaataatttttatttcaccaagtacagcttttattctttctttaactcttttgctatctttaattcttttaaactattaacagtttttatgcttaaaatttatgagctatgcacaggagagtcaaagatgctgctgcctctctttagaggctcatattacagaaactggcgaccctcagttgttcactagttcagtgtgatctgttgaagtttcttacatctctgtctacatgaaactttgacggtgcagggcagtgagccccatgctatcacattaaatagtcatagccatctttcctttactgatttgtgattcttcattttaaatttaaagctcaacaacaaatgaatttttagaacacctttttaacatagtggtttactgggcagtttgtcttgctgctaccacattatattctaattcatgatgaagtaacacaaacaaaggaaagtaaaagaaaggcaaaagagctacactgcttttctctataatttccaaaattcgtgtttttcttgtttctcatttaaacttttgtagaaagtactacttgacagttgtttgtagggagaaagaaaacagaagcaattctgattgtcatgaaattgaaataaggggagtgactttccccttactaactgcaaagtgtaagttagcaaacttcaatgcagcaaaaattggggactagagagttttcgaagatcagctacttgactttctttcacttaatccacatgtgatcagctctggagagaaggcagaagtcacaccaaccaactcccaaaagattgacaaccaggctgcagttgctagaacaccaacaatgctctctggcagggtgttagacattaagcttgtctgaagactctacctagttaataaatccacccaggcaatgataagataggcttgaggaacctggaattaatagaaatagaattggatgatcccaaaagtttctattttaatctggatgatgataataataatactaatattaaaaatgataacaccaacatttattgcatgcctaataggaaccatccactgttttaagattttcttttttgagacagggtcttactgtgtcacctaggctgcagtacagtggtgcgatcacggttcactgcaatctgaccttctgggctcaagcagtccttttacctcagtctcttgagtaactgggaccacaagcatgcacgaccatgcttggctaatttttcaaattttttgtagagacagggtttcaacatgtgcccagcctggtctggtgctcctgggctcaagcgatcatcctgcctcagtgttccaaagtgctgggattacaggcatcagccaccatgccaggctgttttaagatatttttaaaatactaactctgtcttctcagtaacactatttggattacacccttttatacaactgtttggagagaaatataaatctggagggatgaactattctgaccacaccaattgtgcaaggtgaaaactttagggagaatcaatataatggcttttctggaagggtcctttaaaggaagtgggggatagatatgaacatagaaagtaaagaagaggacatcaaatcaatggagcagggagagtgagatgactaggattctgagatgcattttgaatgtcaaatggttgctgtctattgctttacagagcaacagggggtgtagtgtaaatgaattgaactgactgccttaagttcagtggaaaagtagatgaaatacattccttttttttttttttttttttttttttgagagagagtcttgctttgtcacccaaactggagtgcagtggcgcaatttcagctaactgcaacctccacctcctgggttcaagtgattctcgtgccttagcctctggagtagctgggactatcagtgcacaccactatgcccggctaacttttgtatttctagtaaagacagggcttcaccatgttggccaggctggtcttgaacccctggccctaaatgatccgcctgcctcagcctcccaaagtgccaggattacaggtgtgagcctctgcacccagccaatgaaatatcttttaagtagtaaaatgaagtagatttgtctgccaattaaaaaaataaatcataacatttaattagtgatttcttcaaaaatatactaaaacaactctattaacctatcaactgcaaactcctagaagccaatttattttttactcttgagttttcttgtgtatttaagaataaagagaaaacaactaataatttctgggacagcccagccatatggactctgactttctcctccttcaggactcacaggtcagcctgctgctcttattgccaaggagaaggatatttctatccccagcccattcaggacttaatcttgtgtactgattgtgtccagtgaagaatctcttcccctctttctctttcggtccattggttgagttgtgagtgctgaaaagatcattcatatgaccaagattgtgatgcttagatgtttatccccagcaaacatgtaaactatagaaatctcagttgtctccaccaaacatctaaactgtatagcatctaagcagcctgaggctttcaccagatgcccagtcttccagccagcagcattgtgagccaaataaacatttttttctttataaattactcagcctcaggtactccttgttagtgaaaaggaacccaggttcagctgctcatctctcgaaaaccaaactcaagagaagagagatgttgagggggaagcagattcattaggaaagcctgcaaactgagaagacggtagactagtatcttcaaataccatcttaaggcagtacaaatttcaggctctttttatgttaagggcaggcagaagaggaggggggtcaggataaataggtgaccatcaatagcagacaactgggcaccagcacaggaccaaggaatttgaaaaattctttgttctttgtcaggtcacaatgctcctatgaatctttaaggtaacctagttagttgtttacattcttctcctttaatcccagagttagttttaaaaattacatgattgctgtttttgcacattatctctgctctaaaatcatcccaacctacgtgcaagaatgggtgtaggccccgtaaacaaaatggagttagttatgttaggtattttgctgtctcactgctacaattgcaacacaaaatgaatgcttttaaagggctgcttgccaaggaagatctggctttaactacagattcagccacattgcttagtatggttgtctttggctgtctatggttggcattacaatagatgatattttccagtcatagtaatagaaggttttatcaaaaaataaatgtttacaaagtgaaaattgtaaggaacacctcttacaaccaagcagttccaaaacaaacagaaacaaatatggtgggcgcactgagcactttcatgcattgttgtgcatctatataagtgtcatatgctttatgaatttttgttttgcaatcatttgtactccttcattcatttattcattttccaatccacttattccgtttcagggtcaagggtggcaggaacctatcctcacagatcagggtgtaaggtggaaaaccccactgcacaggaagctatttaatcacagggcacattcaaacacacacacacactcactcactgagactggagaaatttagacaaaccaattaacttaacatgcacatatttgggatgcaggaggaaactgaagtacctggagaaaactcatgcaggcatggggagaactccacacagacaaggccctggtgggcactcagtttcttctctcatcagtgttacaaggaaatgacatagaatgaaatgtcattattgggaggtcttcctgtgacccttctgttcaagaattgtcttcgtattgttggtctttaaaggaggctgcatcgtgagcagaatttaagagatcccttgtactgcattgtccccatgaataattttccctgcactgtgatgacttgctgggttctagggagaaatcaaaagtttgcatctgggaacggactaacccccatccttcccaatattctgcaggctgctgtggtgtcagtgttaccgatgccatggacactgatgttggccacagctcaacagaactctgtgttctcagaatccacttcatcttctctccttctgataagaatgatctgaacagttgacttaatggtgctcgttggtattattccatctgctgagtacctgacactgatgtctatgctttaaacatctctgtcctccttccacgttctcaggctgctgctggcttttccagcttattccagtgcatgatgtgtgctttcattgtttgaacaaatgagagtcctgtgcctggtgcagtctcttcctgaaggagtcagaacgtggaagcttctaaacagagtcacagatgagctcctgcattctttatcagctcaatggacatagaggtataggcaggactcccttcatttactgcattttgatgccagactggacatcagtgggtctacacccctacagctcatgactcacccggcaggaagggtggaagtaaggccacacgcacactcctgcttctgaggcttgaaaaacaggactatctccagagggtgctgcatggtgatacctcgccatgtctctctgggcaccaggcactgatccctgcctccccacaccttttctcaggtggactagatgttcctgggtggaggtgggcctgggagcagtaaaacctgtctcctcagtgggacgagggcagggccagcggcccagcactcagtgcccccaccactccccctgcctaggtgcctccaaacctgctactgggttccccaatactgtagattatatataacaagttgaaaactgtgagatatgaaatgagatatggctatagagatttttcaggggagggtgacaatatgaagccaaatcagaacttttacatataaatatggtaaaaagtataatataaatgtaaggaaaaaattacattaaaatgtaagcagttacccaagaatggaaggggttctaatatttgaaaggctaattaggcaatcacaaaagacagaaccaagtgaattaaaaaatgttgatgttgtcctgacgctaaactggttccctacaattggtggaggaggaaaggaaaaatggtttaacatgtaaattagggccctctaacccacgaatagaagagaaacaatctaatggttgggtttctaacctgagtcagagttgagagatccctgctaaattgaatgcctgcctggctgcctgagcaactgaccatgattacttctttaattgcaatattgccaagatgcctctcaattctaccctgttgacacctgtggcagtcactatattctctgaagttactttatgttagtgctctctaaaactattgaatccagatggaactgatgcaagctcattccttattcaaagggaaagtaagaattttctcaattataaagtcgaggggcatgatctgataggaggagtaaattagtaaaactgacaacttacgctaaagagttaatgtaccttcaatcaggacagttttcctgatttcccttgaagtgccacagtcagatggggtggctctcacttccacgtgacctgcagtaagtagagtgagggacgagtcaggaggtcctgggaggctgcataggctggaggcaagggacacctcctgcccctttctctccccagagctgcccattgtccaaagaggacatgtcctgcctgaagctgggagtatatcccctctctaagacatgaaatttaaagaaatgggctcattccagtgtttgggtcagttctttccaggaaatttcctccttttagctctgaagaaaaagctggtggaaggcgacagacttatacagagaacagacttgcccactgtctctggtcttggcaggtaggtggctctctcacagtgtgaagttacccttgataccccaaaagccaaagagatcagggaactcaaggcaagggagagcagagctccagatgcaagaaggacccacccatgactcttggggttcctgaggaagacagaggactccatgtagtgggggggtctgtggcaccttttttttttttcattcttcaaggaatcccaggctttctagaagtcttctctacatccctttatgtggtagccagaactctgatgtttctgcttagtaattttccaaccactgaccactaaatgcagaggcaggggcttgtcgatgataagagagacctagatggaagattgaaggtggcagaaggaaggagggacagaagtaaatggaagaaaaagtcttagaggagccagactgggtaggtcttaagcttcccaaaaaggccaatgaagttttactcttttttttttttttttttttaaccggtaaaaatcctgcctacaagaaaggaagcaaacagaggaatcaagtttataataaaaaaagtttaagtttactgaaaaaaattcccatgggataaacaagaacctaaggagaaaatcagaaagactcttaaaaaaatggtagcctggatatcagctttaaattaagctattatttgaccacagagctcttttaaaaaaatacttttaaatcccttatcagatttcagcaagaaaaaacaaccaatatttctaatgtttgaaactttcttttttttctcttcttttaaaacaacgatacctaccaagcgactcagaaccaaaaccaagtcttttgtgacttaaccaaggatacatgagacatcattaaagaaatgtaaagatgcagccctctcaaaattcagagctacccccacaaatagccaaaagaaagaaagatttagatgccttgagagctggcaataggcaatatgtaagcttttaatgggagcctccaacatttgtttagcccccttcacacaccaaagtgtgtcctgacaggcagcaagccaagttgggttctcaggacacaaaacaggaaaatgacagctgttcgttgaagggaaaggatcaataacaaatgagtccctgaaatccaaatttacataagagaacagttcaaacaaatgatctcctgctgacctgcatttggaaagtaagatataaagataaatttttacctttagttcttgaccagaaactacaggcagagattcagaactcaccttggtaaaaattcttacctttatttgccagctctttatcagttgtcccaggacctcatcaataggtgagtcaggtgcttcagacatcccatcttcatcatcagaactataagggcagaaatagtgtgatctctttccttcctatcaaaagggtcacagctgacacggctataataaggcaggttaacaagcgagaagcatagcacgtttatttaatcatcgttttatataactatggaagccttcaaaatgaagacccaaagtacaggaaaaaactatccatttttatgcttacattccatgaggaatgggcagctgtgcagaaatgtgattagacaaaaagggcatcatctaatgctaatattctgagtaggggaaacccagcaaggcctttctggtcagatacttcttggcctctccatgcaccattccttcctcttgggtatgtggcagagctctttttggaatgggggtcttagtatctacaatcaaacaaggcaggtcagagaatttctttatggccagttcagttcttacacacaaaggtaagggaaagttcaagtaatgtttataggtttttatggctggctttggagagaaagggctctggtttctattaccagccttgggaaagagagtttctactttttatggctagcctcgggagatgaggggtgacaaacaggagggcaggagaaggccagagagaaactttgcttctgaggctgcttcttagatcttcactttggcgtattattttccgagcttcaataggagtgaagaatgagatccagaaaagctggggaagaaggagagaactgtgctgggtattggaatcagcaaatgaatagtatgtctatgtctatttcacttaggtttaagaaaataaactcttccagatttttctgtaagatactgtttcctgactgaatatacaaatgagacttatcttcagtatgaagggtgacttatttttcagttttctccagaatactccaagaattctgctttttatattatatgtgttacagagatttaggagagtattctcttttctgttctttctttcttttttttttttttttttgatggagtctcgctctgtcacccaggctggagtgcagtggcgccatctcagttcactgcaacctctggctccagggttcaagagattctcctgtgtcagcctcccaaatagctgggattacaggcacccatcaccacgcctggctaatttttgtatttttagtagggatggggtttacaatgttggccaggctggtgttgaattcctgaactcaagtgatccacccacctcggcttccaaagtgctgggattacaagcatgagccacggcacccagtcccttttttaatgtatatatataaaggaaataata

SEQ ID NO: 769 - DNA, 2718 bp, Homo sapiens
atcaagcgatcctcccacctgggcctcccaaagtgttgagattacagcatgagccaccacacccagactaaaaggcagtttgattttacaaatcaaaatagcagtaatctatggagatttacttgtgagattggtaggaaacatcttaaatgtaatcaaacaataacttacatcttgatgaattcacgtgtaggtttctcttcctcagaagaaatcagatgctgttcagagcacgaaggctagaattttaccctggttctcatgctaccttgcacccaggttggatcctgagtacagtttttggcaggtgggcctgcatataagttagcaatgggggatacccagctgcctctcttcatacagctgaggttttggggagtcattcttatagcccctgggttgggcctagtcctgcaaatgaattcaccagccctaaagcccaaattgcagcctctgtcattcaccttccaggagtggaaagggcagtaagtttcatcttattattattgctattttggtggttttgttgaggttggtgtgtgtatgttagtaagataaagctctcagaaattacatagcatttgtcaaggatataagagggactgtgccacatctggctgtatagaaggtggttccatatctttaaatagagccccaggtccttagccaccagaaaggttttcaggggaagtgtgcaccctcagcagctgctgctggtgggcaggatgggcacgcatggaacaggctttcctctgtggccaggtgagaagcaggtggtgagacacagagcagtgctgggctctgcttctgaagcctccaacctttccttccctaggaagccccagagagattggtgagggtgatttcccaggaagacgcagtgtgctctgacttctgtgacagtgagcaacgggaccagtggatgtccagatgctggcaatgagtaggccttccctacgctgggtggcgtccacaccctccggcttccattgcctgggtctcctggaggtggtttgctggatgaataccgcatgcacagaggctggccttgggtttgaatatggcagccagtggacagcatgtgcttcagttatgagactgcccaggagatgcttcttccaaggcagagcacgtgcagagtccagtgctggagaggccgggtgcgcagttgacccatttccagttctgttttccctctcatgttcctctgtccccatctaggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtac

SEQ ID NO: 770 - DNA, 15344 bp, Homo sapiens
gtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccgaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggtgagacgtggtcttgtaacacagtggttaagaatgtgactttggagccagcctgctaggggctgaattctgactcagccatttactaactgtgtgaccttaggctggagtgcaatggcatgatctcggctcatcacaacctctgcttcctgggttcaagcgattctcctgcctcagcctcccgagtacctgggactacaggcactcgccaccatgcccggctgatttttgtatttttaatagagatggtttcactatgttggccaggctggtctcgaactcctgaccttgtgatctgcccacctcagcctcgaaaagtgctgggattacaggcgtgagccactgcgcccagccttgtattttttttcagtttgggtagctgtccctaattcatttgttaaaggagaagcaagagcaagaacctttaatctgttctcctcttccctaatttgaaagtagcttgttattttgaatatcactttctctgaaatagcacatctccatctcagagaatggatttaatgtttggatacagccaaaagtcatttcattaccaaaccatggggtgaatataccatgtaaagcagtttgggatcagaactcacagtctgaattgtaagtgatgagactgctgtctctctgctacagcttcttggctggctctgaaggctctttgaaggcagatcctaacaaggggactgctttgaagggccattgttcatttggaatgataaagtctatgttgttcaaaaaacaaatgcttgtagcaggtattttttcactccagactgagaatattggtgggatattgataaggggtactgaatggtaataaacatgtgctctagctctgtgctagtcagcttatttcagaactctagtttgattcagtttcttgcctctgactcaaaatggagggagagtgatttttacataagagaacacacccacatatccttttggcagcagctacctgccagagatgttgaagaagagtagccaacctttacacagcagatattgtgtgccagtcatagtcctaagtataataccttacatgtataaacttcttataaggttggtgctctgtaccgaattgaatagtatcccccaaaattcatgttgtcccagaacctatgaaagtgatcttacttgagggaggggggaggggggagggatagcattaggagatatacctaatgctaaatgacgagttaatgggtgtagcacaccagcatggcacatgtatacatatgtaactaacctgcacattgtgcacatgtaccctaaaacttaaagtataataataataaaataaaaaaaaaaaagaaagtgatcttacttggaaataaggtctttgcacatatgatcaagttgagatgaagttgtactggaaagtctgtctagtgactggtgttgtcataagaagagagggacacagagggaagatggccacatgaagatggaggcagagattgcagttatgctgctgcaaactaaggaatggctctggccctccaaggattgctgataaccaccagaaactagaagagacaaggaaggattcttccctagagccttcagagggagcatggccctactgacacctggatttcaaacttgtagcttcctaaactgcaagagaataaatttctgttgttttaagccatatagtttgtggtaatttgttatggcagtcctaggtaattagtgtacactcttaccatcttcattttcagataaaggaaactgaggcccagagaagtcaaatactttgagatctctgtaggcccctactgtgctggctgtgcatagattccatacctcctgctgttgctgttgttgggtctccacctttaccatggccatcacctcctggcagtgctggagctgagctgctggaataacttgtttttcttttttcttttttttttttcttttaagacagagttttgcactgtcccccaggttggagtgcagtggtgcgatctcggctcactgcaacctttgcttcctgggttcacgccattctcctgcctcagcctcccaagtagctgggactacaggcacacgccaccacgcccagctaatttttgtgcttttagtagagacggcatttcaccatgttggccaggatggtctcgatctcttgaccttgtgatccacctgccttagcctcccaaagtgctgggattacaggcatgagtcaccacgcctggcctatgacttgtttttctaacacaccaggccatagcctttcttaatgttttgcctgcttcatactgtaaatcagaaactcctctcgggaggcttctgactgtagcctgaccatctcacctgatctcttctccaatccctcttcccctctcccctttattttccctttgctatttttacttttcatgcagtgtcagagaagtgtagtgactatgtcgggggaggatcccccagctgcctctggtagttggttttatacttcccacttttggcgtgctgtaccttctagaatttctgtcagtagacaattttgtgtttttctttggagctttcaagatcttgcacatagcttatatagttacatggctgtgaacagagaacgggcagtttcatggtggcattggctgtgagggcacttacattgatgaattcaacccaccacagtggctgtctcccctgtcaaagtgagtgaggggatgagagcattttctgaaccagctcatcttcctgaatagcttcttgcatgcccctgggcttttctgttggcatttaattgctggctgtggaatcttgcctgttttccaatatagacctttggctttagatcctgttcttgttcttacccactctcactaaactgaactccaggaaccacatctcttttgtttgctgctgtatcccaggactgagcaaaggcctgatgcttactaacacctcaagaaatatttattgaatgaagaaatgaatattgacctggaaagttcaaactcttggttttccttgcttcttcctgaagtcaggggccagattaagaatttgtttaatagtcttaagcaatagaaaaattattatgtccctcatactttcatccctccgtatgtattttaaaaacagcgtaaatgcaaaacaagtataaagaaacctagcaaaatataaagaaaatgcagcaaaattctgatttttaccttggttaccactttcataaatataaagtaacttaaaatatttgttgttgttgttgttcttgttttgccagttccctgagcacatgctgttgagtaatcctgcctggaccagtacttccctcaccctagacttcaccttcagttcccctttataccacctgctgaagctgccagccagccttttcgaccaccctccctcccccaggggtgtttggcttctcagaccccagcctgagctagtgcccttggcttcctagggtcttgccaggaaagcaaaggagaacatgcataccgccaaagagtacctaataataagaactcccatcctgaattgtgatttatagtcagcatagcacatgtgtcaggtgattatacttaggctgattttagccttaataatctgcttctgtgatcctgtatgtgggaagcctagaaatttctctgtgatcctccttcctggatcactaagagacaagtcaagacataggtccattctaccacctgtgttaatctgggccttgttgagaccatttaaagaaaggcgtgatgctagaagtaaggtccaggcctcctgcacactgtttcaaggctgtgaccatagtcagatcctgttgcttgagtccaaagagtttaaaatagtgttggaaacctcctagggaaaaaacaaaaaacaaaacaccacatcttcctgggtaaggaagtgacatgtgctgactagagcaggaggggtagccaaggctccaagttctattctggacctgttgttgatttgaggtgtgacattcagcaatctgagctgatgttctgtagctctgattggtttctcatcttctgcagagagagtgaaagaggctgtgcttgcaggggaaaaggtgaacactggtctcctgtcctttaggagagcttcaccattacacgtcctgcctctcatttgaatttccaggcttttttagagtctcgctctattgcccagattggagtgcagtggtgtgatctcggctcactgcaacctctgcctctgggtttaagcgattctctcacctcagcctcccaagtagctggaattataggtgcgtgccaccatgcctggctaatttttgtgtttttagtagagacagggtttcaccatgttggccaggctagtctcgaactcctgacctcaagtgatccacccacctcggcctcccaaccaggcttttttaaatgcagaaaccgcccgcccccagagttaatatggaaacccagcaatgttgtttatgttttacttgaattcgtttcatcagaattgcattccttttaacagtgtgattagatcagctcttagaggggatggcagcttcagtagggtttaggaaaggaaaggaatatttgtgtggggcacacactttggctttgatagcttgaggataccaggtacatgataatttagatggataacagaaacttgtgtcccttgagagccaggcatgtattagatgctttcatacattatttaattgtaatacaaaccaataaagtattcccattttttgcacatgggcaagctgaaagtcaaagaagttatgtaacttgcccaaggtcacacagctaataaaaaggctgagctaggatttatttctcctcaagtctgtacaacgccagagcccatgctgttttcacagagcttttctgtccctggtgagatttaggaaaggagggtaggagaaagaagggtgatgagatgccatttttacccaccttgcgattttgcttgttgggacgtgtttagccagaacattctgtttatagaatactagattctatatatagagatgctgcagcaacatatgtgggaaagataccaattggctgtaggtgaggatttcaaaaagcctttgttcttcatcacagcataggccacacgtgtcaaaacaccactggtaattggtttactgcttaagtggctctgtcctatcatctacataaaatctgttgatgtggctcacaaagtcaggtgtgatggggccagaggtgagggtgtggtgtatcctcactgcatgtactggagctggtggcacctgttgtgtgactactgcagtgaatgattactgagtaaataagaggtgtctcagccaggcgtggtggctcacgcccggaatcccagcactttgggaggccgaggtgggcggatcacctgaggttgggagtttgagaccagcctgaccaacatggagaaaccccgtctctactaaaaatacaaaattagctgggcgtggtggctcatgcctgtgatcccagccacttgggaggctgtggcaggagaatcgcctgaatccgcgaggcggtggttgccgtgagccgagatcgtgtcattgcactctagcctgggcaacaagagtggaactctgtctcagaaaaacaaaacaaaacattaggtgtctccttttttcttctccaagggagaccagatagcagtgggtgctggcacacatccagggatcctggcccctgggctagcagaagagatggcttgaaggtgtcaggtgatggaataaaaagagctggtctgtcaagtggtataatttcaggggaccaagaatgtgtcctgcccctcaaaaacttgccctagctgtttgctattgcttgggatcccacaattgaaatttctttttcttgatttaaatctttgagaccctattaaaaatgaagagactccaggaagagttttgattgtgaaacattttggtcatgttaactggaagtatgaatgagtttataagattgatttctgagaaccagactgaggaagggatagggaggagaaggcactgtgcccctagttgcagggacaagaaggagacaccaatgagtttgagataaaggccttgaagagagatgctgggtctctaaagaaatacttggtttccttcacagttttgtctgagaaaagacaagcagctgacagtgctggttatggaggcccatgaccccaaaagaggttgtgctgagtagatagcccaccagcatgttcggatggaggcacaatgttgtctggagagcagctgacagctataatgtaaccaggagtgctggacctttgggtctgtggtttactgtgatgtactgagacaaagactgtcacagatcttagaagggggaggcacagcttccaagaaatgatgcaaaatggtggcgcaaaagaggccaccagtggcaacaagggcagggcatttcctttgtggctggtggtcacggacaacttctggtctcaatttcccaatgagctatgctaagaaatttaccagaaagcaaaataagccatgcaaaaagcgatgacaaagcacttggggtatccatgcaaaggtgcagttcccccttgtccactaattttgtggagccaaaagagctgatccagaagctgcaaagatagtccctgtgattaagacatacaacttttttttttttaaatgcgagactctgtcttactctgccacccaggctggagtgcagtagagcaatcttggctcactgcaacttccacctcctgggttcaagtgattttcctgccttagcgtcccaagtagctgggattacaggcgcgcaccaccacgcccagctaatttttgtatttttagtggagatggggtttcaccatgttggccaggctggtcttgaactcctgacctcaggtgatacacccgcctcggcctcccaaagaaggcatacagcttttttggcctgagttcttccaaagagagacccttcctagttgacttggcatcatctttcattcaccagtgttctctaactgcctttatgattagaattctcacagcgttttctcccccaagggcatattttacagaggcaactcaaatctcagtgcctttctgaactccttacaattgggtttatagatgcctccaccctgaggttcaatttcactgtccatattcctattctaagtctggagcactttatttttgatccagacttttagcttcactgaggcctcttgggttctagctaatttttttggacacatttccctagtgggcagcctaggaatggcctgtcctccctatcccccaaagtttggcaaggtctgtaccccctaccttaatggaatcagcactacttgagatttctgaacatcctacaccgtttcctctcccctcaacccctgcagcctcatacacgaggtctagtggaaagcaggatctgctgatcactaggatattagagccagtgtctccagtagggaagaactcctgggcatgtgttctatgccctgaatgacagctctctgcctatcagtttctgctttccctccatctcacctttattttggcttttacctagaagtacaaactttgtcttgttcctctgcctggacttcctaaccctgtccaggactaaagccctgctgtcagtccctcaccagggactttccacactttccctggccaggtcacttatctgatactagagccttttcttgcatctaggctttagtaggtagagttctgtccatgcacagatctccctgtgttgaccaccttgaacttcgcctagtgctctttgcgctaattagatgccatgctagtctgtcctgctgccttctggaacaaggctcttagctttgttgagctcttgccctggatttcatgttagctgtccagctgcctgcacctcaaaaagagcttttaatatgcattataaaactccaaaagggaaatagaatatataacatttttcaaacgtatttaactagagatccattttttttttctgaaggaatatttattaaaatcttacagaatatgtgtttggtggaatacagttttggaaagagtgaatctttatcccaaaggaatggacatcaaatagagtaattccagatgaagataatgttactattaccttcatctgaaattccagatgaaggtagtaatcactatttcctgtgtgtctgcataaggatagctctaatccgcagtggaactctaaaatagggaggaaggaagaattctgcattctttcttccactttgaatcctcttcttcccaatggaaacaggaagtggtaaatgcaatggtgccatcacggccatggtcgtcactggcttctggatacaagataggagggcttctctgaggctctcttccctagattggacctctcagaatttctctagagtgctcctgagcacccttccttctactctgggactatattcatctcagcatcagtctcaagtttaactgctagttcaggattttgatgttacacatggggatcagtgccagatgggatgtagctcatttttatggaatgagtatgacataaattttctcctttccctattaaatttctcttctatatcttgtgggcagtccagactataatttttttttcaatccttgaatggagataagctcatgctctgtgggcagggcggtgttacaggtgggtcgccatttaaatccgactgggtgggtgaccacgtaccaggaatggaagttggcttagctagtaaccaaagagcaagccagttacttcccctgcatgccattcccaaccagcacagctggggaaagaccacctgaaagaaatctctaagacttctgatgaagaaattactaggtcctcttgagaccctcatgtatgtgtctttattgtcgtgagtgagatcattagttggctgatctcagttggcttagctaatcataaactagatggaaaggctcagctttgaccatgaccttaaatatggatggaccatgtccttaggtatgttctttgagcatccagtaagcagcattctccgtagacaagccccacccttggggccttagcctatggcatttgtccatttttgccatttcttctgaaagactatggttttaactgaagaccagggagtcagctcgcttataggaagtgggaagagggcttgaaatgggcattcagagatcttaaatagagcttgtagtttatttggtcagtctacaagtatttgccacgttagtttagtttagtttagtttagttttgagtcggagtctcactctgtcacccaggctggaatacagtggtgtgatctcggctcactgaaacctctgcctcccgggttcaagtgattctcctgcctcagcctcccgagtaggtcagattacaggggcctgccactgcgcccggctaatttttgtacttttagtaaagacgaagtttcaccatcttggccaggctggtcttgaacttttgacctcatgatccacctgcctcggcctcccaaagtgctgggattacaggcgtgagccaccgtgcccagccggtatttgctaagtattaattggcttataactgtggaaaacttgttaacagctttaggaaggctgttagggaaagtctcaggttgcagtgagctgagatcaggccattgcactccggcctgggtgacagagcaagactccatctcaaaataaatgaataaaaatttaaaaaataaataaagagacaaagtcttgctctgtcactcaggctagagtgcggtggtgtgatcacagttcactgcagcttcaaacttctgagctcaagcaatcttcctgtctcagcctccctgagtagttgagattacataggtgggtgccactatgcccaactgtctctactccctctatatactgtctctagatgatgccatctatatttattggttcagctaccactgatacatcaagtactttaataccatcatcctccacctagatttttctctcttctgagtttcttactcataatagccaaacactattggcattgtaacctggatagctcttaagcaccttaaactcaacatgtctcaagccaaattatattgttcatcacaccattctctttccctttccaaacctcctcctcctcctcatttccttgatttaggagcatcactgtctggcgtcatttgttaacatgcttttgcattactgttttctattcccccactgggaatttaatagtctccggttgtaatgtaagatgtttaggatgtggttctttcttttcttattcaagaacaattaaaggttaagctgagattcagactctaagtaaaatggaagtcgtggagaggaagcatctgagggctagaaccttggaagaaaacttgagagttgactaaggccacccttaggtgcagtaggggccagaagacctttttaggagcatgcagaatggagaagaggtggggcatatgatcctcagtttgtttcttgtgcaagcagagtaattggcacctcccctgctggctgtttgtgtaaatcactgtggaacctcatgtaatctggtttaaacgtctaaggattgagcatcctagtataacccatcagctagctggagtcatccttctccttaaagttttggctgaaaatgtcattcttcaacttacagcaagttgttctgattccttcttcagatttcttcaaattcccaggagctctgattttgagctcttgcttccattgaatttgtttagattatggatggtttactagatcaagtacactgaccctgtttccatccacaatgatacagatgtagaactcccagctaaagcctttatatgcgttgcagactttatcaaaggtttgggataatggagagaattcaacattgcaacaaagtaagcaacttgaattctaatactggttattcctgttcctcagagtacttttgcccacccctccactagggatttgtcattattcatatcacccacatatgttggctttgttttttttttttttttgagatggagttttgctttcgttgccccggctggagtgccatggcatgatctcggcttactgcaacctttgcctcccacgttcaagtgattctcctacctcagcctcccaagtagctgggattacaggcatgtgccactatgcctggctaatttttgtatttttagtagagacagggtttctccatgttggtcaggctggtctcgaactcccaacctcaggtgatccgcccacctcggcttcccaaagtgctgggattacaggcgtaagccaccccacccagctggccttggtcttttataatcttatctttctctcctctgcaaactctccttagcatattaccactagaactccaaatacttctgtcattctattttgcaagcaatttaactctctcaaactcttcctcctaaaatcacttctgggttcacttctgtgtgtccagagcctaccaagggggaataaagagcttcatacgcttttttttcccccttgagacatggttttgttctgttgccaaggctggagtgaagtgctatgatgtggtcatagctcattgtaacctcaaactcttggcctcaggcaatcctcccaccttagcctcctgagtagctagcacttacaggtgatcaccaccacacctggctactattttttttgtcttttagtgacagggtcttggtatgttgcccaggctggtcttgaacttggtatgttgcccagcctggttgcccaggccactggcctcaagcaattcaactttcttggcctcccaaagtgttgggaatacaagcatgagccactctgcccagccttcatgcatttctttagctacacaaagaataatatgtagaccctctgatgtttacttttccattatcttccatcttttgaaggtatttcttgttttgagtagcacttactgcttatctgcataatggttttacattgaaggatctatggaggaaaaataggaggatattctaggtaaaagcaacaataaaagcagcaaccttcacaaaacctgttgtggacaaatgaaaaactagtccaactgggcagaagaattcttgtcaaggaggagagctcacaatagattagaaaatccagaaacagacctaggtttcagcaggaaaggatagtgttaggacaaatgatacaggacagctggctgacaagaaaaaaaatttctgtcaccatataacaaaattaattctaaatggattacaagtttttacataaaaactaaagtaataaatgtactagaagataattttttttttgaagtatggcactaaaggcagaaactataaaggaaaatgtgtgatgaattagctaaaaaaaagtaacagcataagcaaaagtacatgacaaactggttaaaaacagttttcaacatatctctaatgtacacagagcttttacacgttaataggaaaaaaaataccacaaaaaaatgggccaaagtcatagaagaataaattcaaatgtgactaacaaagcatatagaaaaaggctatttcagccaggcgcagtgcctcatgcctgtaatcccaacactttgggaggtttttacaaaaatgaattagccaggagtggtggtgcacacctgtagtcccagcagtagctcaggaggctgaggcacgagaacggcctgaatgcaggaggcggaggttgcagtcagctgagatcacgccactgtgccccagcctgagtgacagagcaagactcatgcctgtaatcccagcactttaggaagttgaggcaggcagattgcttgagctcaggagtttgagaacagactaacaagtcactgattatgccaaggtgtttatctacaccaaaattggaaggttacctatcatgatggaaatggggctaactggaaaggggagccactcctctagaaggggaagatggatttgtttcctggagttgaatttgaagagctagaggtacatccaagaggaaatgttccataggctggagatttccatttagagaaaaaaattacttctaaagtagaagcaataggtgggagtggagactccctagatttggcacctttgacaggcttggaggggaggtggtattttggttcttcccttcctgccagaagtctccttgagagagactggagaggagtgtgtggtctcaattagaacctgaagagtagagactggggagaggtaggagtgggcagtaatcataaacaacagccacaacagcatttaaaaattactttaggccaggcgcagtggctcatacctgtaatcccagcgctttgggaggctgaggtgggaggatcccttgagcctaggagttcgaggctgcagtgagccatgatcgtgccactgcactccagcctgggtgacagagtgagtccctgtcttggaaaaaaataaaaattactttagaaagtgacactatagtgacttaagtaacagaatcctgtgtgttttagattattacttttttttgttttttgtttatgtgtacacttccaattttggtgtagacaaacaccttggcattatcagtgacttgttactctgttctcctcttcctgcctgagagactgtcaaatcagcacttattctataaagtgtctttagattgatccatttctttataatcccacccgcccacgctagttgctaccttattatttcatacttgtattgccattacagcttactaactggtttctctaatttcattttctgcttcattcattttgcatgctacaacataaaacctgccctgatcactgcttttatcaccactatctgctcaagagcctacaatggctcttcattaccaagcccaccaaggtaaaataattttgtccggtttcagcccacccaccatattcaagtaacagggtgtctctttttctgcccacctcttcactgctcctagctccaggctgcagcttttgctctgtctgcccctctttggaaaattcatctctaagagacagggagtggagaaatgagaaatgaactttgagg

SEQ ID NO: 771 - DNA, 1315 bp, Homo sapiens
gcaaagtgctattccaaacagatataacttcatcttaactttgacattttacagataccttccaattttttttttttgagatggagtcttgctctgtcgcccagggtggagtgcagtggcatgattttggctcactgcaacctccacctcctgggttcaagcgattgtccggcctcagcctcatgagtagctgggactacaggcgcccgccaccacgcctggctaattttttgcatttttagtagagacggagtttcacgatgttagccaggatggtcttgatctcctgacctcatgatccacccgcctcagcctcccaaagtgctgggattacaggcgtgagcgaccatgcccagtcccaaatatttttaaaattgcaaatgacaaagtcaatggggttcaaaactaaattcttaaactaagtaaggagataacagacaacatttaaatttgtctttggaaaacaactatgaaatattaccattttctcctatcagatcaagtcagtatttcattctgaaagcaatgtattaacatgtgattttatgaaataatcaaggtataggcaagctctcttgcggagcatacacattaactcaggatcatcctcattgctgttttttttcccccagcacttgtgaggccttgtaggggacagtggattaaatagccttcagggtcaaaacagttccttgacatttggattttaaactcctggtaattaaaattgattgcataatttactcctattacaggtgtgacacactgtgagattcaggattataattctttggacttaaaatggttggaaacaagctgggggatctggactttttcttccctccatgccttccctcttcaatctgaagactcagaaattatcccaaaccatagaaaagtggagtatttgagaatgaataaacttataatccaatgagtagatttctaattattatctataaagagatgaagagcagtggatagtggaacaagaattaacacagggagaaaggaatctcacctttagaatatctctaggataatatttttcagacaactgactccctccaatcctcttttgggtaatgataaaactaaatgtctgatctgcaaagaaaactctcaccagagacctgctgattcaagaattcagttcctgcccaattggaatactgccaacatttttccaacctaacaggaatgcgtctgcagtctaagtaagagcttcttctctgaaggtaaaagacgggaagttttggtgttgttgacatttcagtgagtgctgccaacatctggcatactagaattgatctac

SEQ ID NO: 772 - DNA, 2442 bp, Homo sapiens
taatatatgcaacgcttggccctcgtgtctgacatgtaatggacactgttatctttaattgcaaagctaatatttattcaaccctgtaataaaacagagtcctaggtgtctgtgaagtaatgaggaggatataaacctctgagcaaagctgagtgagctttcacaaccatgaggttctctaaaaatgacaaagcagacccttgagctcatctggctctaagagtgtcctaagcactcactccatctcctactggattgatgtaagtataaaacaccttcatgggcaattcaactgttaggaaagaggtgtaagcctcacaccacagactgcagagatagtaatacctgttgtgagaagctgtctggtatccaactgccaaagcctgtctcaggatatcattcaccagctgttctgtagcctacaatggaagatgctgttattcttcaaatggccatctgcttgctggcaagaagggacacatttaaccccatcccttaccccaaatgtttgaaaccactgcaactagggattaaaaagtccttaagaaaaaattaaaggcctcaataatagaccataatgataaaggccatgattctgagaaattatgaattggagtgattttcattaatcagacattattctatttatttatttattttgagatggagtctcactctcgcgcccaggctggagcgcagtggcgcgatcttggctcagtgcaacctccgcctcccgggttcaagcgattctcctgcctcagcctcccaagtagctgggattaccaggcacccaccttcaggatcatgtcctccaccacggacgcatacacgttcctgtggagtgccacgggctgcagggtgatcccaatctggaaaagcagaagaaagccgtttgttcgtatcgctgctttagaaacagcctctctccaaacaagcatacctccctgacatgcaaagcgatgcctggttggaaggaggactctgcaaacatattgggcaaaattcacgggaaaggaacacggaatataacatctagaagaatgttatcttgtttttccacatttctggctgatatttaaaatatgactataatcctattaaaatctctcaaatctccttcgtgggagaacatggttgggatctgcctgggttctgatacgcaatcaacactttgaaaggtctggaatcagactccaacgtcctgtttgcacttggaaactgcatcttgcccattcttcatggcatccaatgaaagcacactgtctttcaccttgggccctgagcaactggcagatgctgaagagctgttaggctccagcagggtggataaatacctctctcctgtatagtaaggcaggtgcacgccatctgcaccacaggcggggcactcaggagctatcaacacatcaggggaggattacgcgctgacgtgcaactcagaaagagtacgacgtgcctcatgagggaaaggtgcttctactgaggcagatgagaaaaacaagatgaagagtaatcaaccatttctatctagccagctttgcttcacgtctgcgttcaacaagcaatgttttcacatgtaattagcatttctgcccaagggctctgatgtgggacggtgggagccctgagagcacacctgggtcaaccaggcagaaggaagtcaagcatctacggcaccagaagagtctgggtctgagtctgtgtctgtgaggctgaacacctgggtctgggtctgtgaagctgaacgtctgaacatctagctctgagctggtctgctgcatgaactattaacaccacaacccctaccttctgtgtgacatccccaataaattcagaccctggggttggtggcaggtagaacttgacttcctcttgtttctcttcctgctccttcttgatgtttatcttcactggctcggagaggctgaggatgtccacctcctcctcattctcgggttcccttttctggaactgttgcaggtcctccagtttgcggcagaggttgtcagcagaggagaatgatgatgggcactctaaatgacaggcaagcagtgttacaacagctgtggggccaacggaagaggactttccgtctccaagagacccatggtctgaggaagggggataagcatcaggggagctgaccttctttccagttctaacattctatggatctataatgatgagaactagtaattcacgagggagaaaggcataaacacaggcatcttgtgtgtgatctatgtaaggtaactgccatctaagatgaaagagtaggaattctcacttctgccaccaaaaaccaggtcatccccctccctctgagtattaaggactgacctgatttttcctcatctcaaatctggaaaatttagaaatgcagagtgaagaaaataaaaagaatcacccctattctcactgctcagagagcaggactgttaa

SEQ ID NO: 773 - DNA, 3135 bp, Homo sapiens
tccgggtctaccggaaactgcgctctaggcgttcgccccccgcggtccgcttccgggtttgcacgaaattgcgcgcgcatcctagaggccggactggctgggaccagggcgggccgggacaaagcctgggccgggcctgcgcttccgttcgcttgactggctgcgcttgttttcagggttttggtctgaaaacggatcttacctgcgcagagcaaaatcggttgtagattatatccacgaaaattccttctattaaaatgaatttcaagtcccacctaccctggaagcagaaagagagagaagagagagagtaaagagaaagagaaaagaaagagaagttgaaaaagagaaagaaaaccaagaaagaaagagaaaaaaaccgaaaataaatggacaagaaagaaaagtaaggagggaagggaagggaggaagggaagggaagctttaggaattgaattaacacactttggaattgtctgtgaaggggatgatgcaagctaaaatgtgaaatgcaaaaccctgccagggtagaatgttctatttcatgccagtgcccatagaagataaatacttttcatttatcttccccattcactctagacggtgaaggtcaaccctgtgctcaattccagagactttcctagggacatcgtgttgggcatggaggactaaggccagtgtgaagataagtcaccgattctttaaaaaaaaaaagccagtaacttataaaaatagccataaacgacgtagttttttgttgttgttgttgttttgagacagcgtctccctctgtcccccaggcgggagtacagtggcaggcactcagctcactgtaacctccgcctcctgggttcaagtgattctcttgccccagcctccagagtagccaccacgcccggtccaacttagttttttaatactttttaaaattttaagacagggtctctgccaccgaggctgaaatgcagtggcgcaatcatagctcactgcaaccttgacttcctggggtcctgggcaggtgaccccctgtctcagcctgccgagtagctgtgagtaaaggcctgtgcctctccactgtgctaattttctactgtttgttgctttgtttttaatagagatgtagtctggttttgttgcccaggctggtctccagcttctagcctcaagcagtcttcccatctgctcctaccaaagtgctcggattataggcatgaatcaccttgcatgggagataaggacccccacatcaagccctcaggttatttttgaaacacaaatacataaggcccacaagcaggcccattggctgcagacagtggggtcacctgaagaacttttctttgatctgagtaccaacttctcacctaggtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggtcagtgcacatgtaaatggactagctttattaaaggggatatctgggccaggcgtggtggctcacgcctgtaatcccaatactttgggaggccgaggagggcagatcacctgaggtcgggaattagagaccagcctggttaacatggtgaaacgaagtctctactaaaaatacaaaaaaaaaaaaaaaaaaaattagccaggcatggtggcacacgcctgtagtcccagctactcgagaggctgagacacaagaattgcttgaatctgggaggtggaggtgcagtaagccaagattgcgccactgcactccagcctgggagacagagcgagactccgtctcaaaaaatataaaaataaaagggatatctggattggcggagagactgcaggacagcattcaagtggggttgaattggcccagttgcatctgacttctcacttgtagttcccaagaatgaatatagaatgtgctggaaaagcaacatcctgagaggaagggaccggtgagaaaaggacaggatgtgttccagatccccagaacaggatcccctttgttgctttaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccaggtatctgccgatctgtatgtaacaaattcacttcatgtaacttactgtgtgtccgtgagattatctctcactcaactcagacacattggcaaccagtgtgcagtgaacctgcttcacaagcaaggatgtggagaaactattttcgtacattttgtgggaatctgaaatactgcggtcagtatggaaagcagtatcatgggaaacttcctcaactcaagatcacctaccaatccttacagaatcagaatcatcatacaaactggtgaaagcatagtttcccctagaggttgggatgagggcaagaatgtcccctcttatcactactattccacacaatatgaaaggttccagccagtgaaataaaggaaaaagaaataaaagtgacaggctgggtgtggtgtctgaggcctgtaatcacagtgctttgggaggctgaggaaggagggtggcctgaggacaggacaaaaaaaatagtgtaccaacagaaaatatgttggttgtgcaggctaatacctttcccaaaggaaggtagctacatccctatgacctgtgttactggatatatcaaaagggagtttgcaaatgtggtctagataaggatctttagatagacatcctgaattatatggtcaaagtgatagaatcacaaggttcaatatcagaagggtgcaggtggatgcgaagggacagagacagtggtgatgtgttgaaaatagagggataaagagattttttttctcacctttaaagatggaggaagtggaccatgagtcaaaggatgtaagtggcctctggaacctacaaagggtaaggaaacaaattctcccctggagattaatgaagaatcacagaactatggacccat

SEQ ID NO: 774 - DNA, 2616 bp, Homo sapiens
taaaatgtcgaactcctttgtatgtatggatcagttttcagcattttatcctttgcactttcaatgtcatgaaataatctttgattccctttactatgaagttttttgtcagcatcacttcctctgggatatcttcatcctttctgtcgtggccactttcctctttatgtcaataattttgcctccactgagtttttctggctagatattaagagtgtctcaaacagtggaagtatcaacatttccatggtcagctgtttcttctataacaccgttcaattgatcttccctaccaatatcttcatttttagtttctttgctgcattttcatctttgttgtccaattccctcatttgattattcatttttgtaaaatgttatggggatttattacagagagagaaacaaggaggcaacacaagtaactacatattgtgctttctgtgcatgaagtgaacaataggtatgcttcaactaatcactatcactgacacattttgaagtgatgtgactagtcaatgatcacagtgctcatctgttgttttgtactgacttgtgggctgaagagctagcagtaagtttgtgctttatgcagttttcacagtaagtctttgttacaaatttgtatcgccttattgggagacttgttatttaagtaaaccacagtaactgaaattttaaaatattggaaccatcaaatccagacccaaaacattaatacctacacatactctctagggttaaaatatctgagctaaatttatatttaaatttgcaagagacagctttcatacaaatatatccatttatatataaatatgtttatatgtatacatacagtctatgttttcatatatataactaggttatatataattcaattatatataatttatatgtaataggctgtatatagagatatagattatataaataaaattatagctgtagcctatttattggcctagtaaaaaccatataatactacaacagactagaccttcatttgagcacacaagtaagtctgttttgagtgagagcttctttgagtgattctgtgaacttcattgcgtttggtctagctgaacttgacattccttttaatttttctactaacgcgccagctccgatgctccacattcttacaactaactcatgatcagcttttatttctcagatctcctgtaattccatcttaagctcttatttatttggagaccttcaccgcaatatacttttcccagccattaatttcagtattgtctgggttttttgtttgtttttgtagcagattgttcattctgctgattgttgtatattagtttggggttacagtttcttgtatgaatatgtataactctcctactactttgtaaagccagggcagttactaaacatttagcattgagtctggcatgtagtaagtcctcatacatgatagtttctttgtctctttgctgtctctagtaaaagtagctgcacgtatcagggacttatattttaaaattttaattgtaactttggctctgcagtgcccatgtcaggcttttacttgtcaggcaaattgttatggtataccattttctttttctcctttatttgaatctcccctctttaagattttcttactacccttacatgttttagattcttgtttttgcaattgtggattattttcatctctttttagtcttctcctgtctgttctaattctcaaaatcaagtttttccatctctgaccatatgcttagttggcattgattgtacacttcctgtgagtttatgcatttacataaattacactacaatggggcatttttcttattaattaagaaatactagtattcattaaggaattattgctctgtagttataaattctttaagttaaatgcaaaatatcaaagcagcttctgatttttttctttttgttacagaaaaaactcccatgtctgcacattcatagtgtgcatggaagaagagggaaaaatacctttttacagttttggtgcttggggcttattgttattattggtagctggtttatagaaatttgagatatttttgactttctatattaaaatttactataatagtcttacatgaaaatctttagataagcaggaggatttgccaaaataatttttttatcagattttaaggttttgtgtgtatttctaatttttgtttcaattgcttttcctgtctgctttcaacttagcatgagggcttcctatctaatatcaaataaaattatgttaaatatgaatatattagatacagattgtaggagggggggatggttaagtgaggtatcctaattgatctatacttaactctaaattccaatactctacggcaataccatcaaatgacagtaaaagttgtgttatcacttcagtgaaatcatttcttaacataagaagactgattttgacttactagttttagaataagattaagtaagaagacttaaaggcccacctttgaactcataaaaagcctggcctagtgaaaaagcatattttactggtttgcttgcttaaaattatttaagactcatattttaccttggagatgattttgcctataaattaataaagatgtatgtttctgg

SEQ ID NO: 775 - DNA, 1653 bp, Homo sapiens
acgctaggggcctggcagggggcagcaagagaccgcgatggcctatatacatatacccatagagtatattgaatatttttattcaaccctatgaggcaggtatcatagttttgcagatgaaactgaggctcagatgaattaagtgactgtgtgtcttcgtccatttttgtgttgctataaaggattacctgaagctgagtaatttataaagaaaagaagttcaattggctcacagttctgcaggctgtacaggaagcatggcactgacatcttctcagcttctggtgagggcctcaggaagtttacaatcatggtggaaggcaaagggggagcaagcgtctcatgtggcaagagggaacaaacaggagacaggaggtgccacacacttttaaacaacaggatctcacaagagcttactcttacaaggacagcaccaagaatatgaggaatctgcccgcatgacccaaacacttccctccaggccccacctccaacactggggattacatctcaacactggatttggaggggacatccaaactatatcaaggctgtacaagaagcttggtgccagcatttgcttctacgcagagcctcaggctgcttctactcacagtaaaaggcaaaagggcatgcaaagatcatgtggcaagagaagaagtgagggatgggggatgccatgctctttttaacaaccagctctcatgggaaccaagagggacaactcactcattatagcaccaagcctgtatccctcccattatgccctacctccaacatcgaggatcaaatttcaacatgaggtttggaggctcaaatatccaaacaatggcattatgtcaggatcataaagctaatgtttgtgaaaccaggatctgaacccaagctattgcttctagaacctgtactcttaagcccttgcttatactgcatttgaaattatgcttcattgtataaaaagtccttttcacctcaagcttatagagaagtcaccttgttcttaaaaagtcctttacacttcaagttcataaagctcaggcacatatattttcttccagtacgttcattattatttttcttggttttcctttaaatctttgaatcatctggattttattttggaatgagaaatgaagtagaaatttatttttgtttcttttcagaatggctggtcaattgtcctaacatcatttaatgaatagtatttatttcccctttgctttgaaatactactttatcatatactaaattataaagtaatcttttattatcatttttgaatgactgcattccagttgtggaagatattactcaaagtctgttgtgattatctaacttaagtgttgatatgaagaaaggaaagtaggtttcagcctgatttaagaattttcctcctctccctctccctctccctctccctctccctccccctccccctgcccctccctgtctccctctctctctccctctctttctacgtctccctctcttgccgagcctggactgtactgccatgatctcggctcactgcaacctctctgcctcaggctcccatgattctcctgcctcggcctgctgagtgcctgggattccaggcacgcaccaccacttctgactgatttttgtatttttggtggagacggggtttcactg

SEQ ID NO: 776 - DNA, 2375 bp, Homo sapiens
attctgtactagatcaggagagagaatgttggttcaaatctaagatgcagagcagattggttaaggactaagttagttgatcatttcctaagacaagactaggactagcagcaaaggtggtatggatactatcaagatgagaggagaagtggacaaactgaaaactagttcaaggtctaactttacaaacatgacctacccactgtggcatccctcttacgcttagcctgatgtgctttggtagaggaagcaccacccatatgagtctgcatttgccaaaggtgccttagaagaaagggaaagaactggaacaggtcagcaagtcccatgctaatgggactcatgtcaagctgggtcaagttggggtgtagatctctcattgagagctaaagcatggcgctaaaataagggaaagcagagacatagaaaacaatcaaatctgaagaaaccagaggatggagatggaggctgtagaacaaggtgggaatggaagctggtggagaacaataaggtaaggacctgatcaaatccctcaaccatcaggggttgctgctggtttggatctgtggacaagtaggactataaatgtggcttgatctggtgggacagtttaaaataccaggaacaggaaaaaaaaaagatatactttgcagaccacctttctaccctaacataggaaagctttagtttctctttcttatcctggtttacccaagaatgaacttaatggttccatgaaaaggatatgtacagtttctgttgatctaaaatcaagtcaggtttagatgaagtctctaaagagcctttgtcacacttagaactccaaccatgtgaggtcagactggggaggctaggggaaggcaactagggtttacaggtctctctaaaatatgatcacttaccctttcctcaccatgcagagccttagttaccaaagagtaggaaaatggccacgtgtctgggttgccacagaagaggatttgtggcttgaatcctattaagaggaactgagaagtcataagcctatggtatagatttcattctcttagtccagggaaaacaatttaagaagggcaagtatcaacctccatgcctttatttggacctcccaacatctctttcaagtagatgacatgatccacttctccccaaacaagtgcctaataatgagctttagaccattctctcaggtacaatgtcacaaagacctcctcagacatggaaaaggggatggggcaaggagagaacagctgttctgtagacaaccagtagtgcctgttgctggggcgattgggctgtctttttgatttatttcccgaatagaggcaaactcacatcatttgaaaggcatcttaggagatgaaatctgcctccatgagatcatggatattgttgatgtcctagctcaggagtaagcaattccattttaaactcttgctgtgatgtgactctccaaaaaacatttcctaagttacatgtaaaagcaagtcattaaaaaaatgcagcttgcttttatttctatgtttagcctgcagttcatcaaacctcaccctctgggctagcagcccgcaaatatctcatagcacttactaaagtgtgtaatgatttgatgaatttgtttatttctctgcctctccctccacctttactgtaagattcatctgtcttgttcaccattctatctgaagcatgtagcaccaaacctagccatagtagtcattcaataaaaaggctgaatgaataagggaatgaatgaaaattttggattggtaaattgcaaggcctctctttagagcagaagagacacctagcactagcaacatctttaccaaatttttattgaacacaaaggactatttttaatgcttgcccctgtaggtcctgctgaggatccctggtgcccagtagggaacaccgtgaggaggaggattaagaaaggcaccctttccactgatttgcatcgccatttgtacatggagtttggctacagcaaaatccgttgctatctcaccagctacaagaagcaaagaacgaattgcaattcatttttgtgctctaggacccggttgagggtaagagaaaagaagtcttgtctttccaattctccagggatctcaaactcctcattttttattgctgtgtaccaagctcccagaggtgacttaaaatgagctccatcctgaaacagatgaaacactggctgcataagtactgccccagcgttaagatgtgtggtctttggaccacttttcctcctgggcagaaaagcagagtagagtcctagtgaatgtgagaggatgaaagaatgggagggcttcagaaaggtactagccaatcaaggctctgatgatcatggaatagttatatctgttcag

SEQ ID NO: 777 - DNA, 1605 bp, Homo sapiens
ttttataattaaaatgtttataattacatattttataattaaaatgtttataattacatattttataattacatattttataaagtatttataattacatattttataattaaagtatttataattacatattttataattaaagtatttataattacatattttataattcaatattttataaatagttaaaaagacgaggaaaaaattaaaaagacgaggttattgatctcaggaattgtatttgccaagtgagaaggaaaaaatattcacaaaggcttgtacatactttgatcctgaggaacacctctggtgtcttcatgtgccacatagtcttcctcactgactgtctgcctttgcaaggcaaggctctccggtaggcctcgagatgaaataacaagtcctttatttcactcagcctgccaggagtggagaaggaatggctagggagtcctagccccaggggcttcatggcaatacggaccccagatgtctccctggagctctgccaggatccattcaaggccaagaaagtatgattgggagaggaggggtggagatgtagattcctaacaattctgtgacccagcatacatgtatgctctttaggctcttaagcatccttatttttccaaatataatatccaacaatcccaagtgtagtaaaaacccaagggtttctcctgccacatccactcacttcaaactctgattttaaacactggcaatatccagtcagagcctccaagctgagctctagaaagagaaagctgcaaaaaacctgtgcaacaaaacttgcactcatattactgacaagggtagatataaaacagcgcattcttttccatgacactgaagagcaaagaagagtgtaacttgggggcaataagaaattggaggtcaccacctcccaaatcctacatgaggtctatttggaaaagacctccttttttaattcaaaaatccttcaacctccaccattctttcataaagcttcacattctcttggtgaagcccactgttaaaatgcacaggcgttacctggaaaaggaaacacatagccttaacaatattcttctgtactgaactgaagagtgagaaagagtctatggagctataatacggtagtgtatgaatctggtactcaaggaaagtctgttggataatggatggatggatggatggatggatgggtgggtgagcgaataaatgagtggataaatgaggggtcagttttgagagtgagagaaacatggaaattagactcaaatcccaaggcaccacatggaatagttccaggaatagttctgcaagagtttccctgatgagctataagcagcaaaaatttagtgagtgttcaaactgaaaggaggcctggaattgtggcttaatttggagggaaagagggagtccaagattcccagtgcttatttgttgatatctatctagtgctgaaaagaaaaaaaaatagccacaaatccaaaatgattgtgcagtcacatggtacccactgcccagttccttgaccagtgtccctcatacaaagggcccctgatgagctcagaatgtctttgttgtactgaataaagtttgaagaacaaggga

SEQ ID NO: 778 - DNA, 10376 bp, Homo sapiens
attctgtatcaccctcgctcaaggacctggactgaaggatttctgctttcaagaagaaaaaaaaaaatagaagacatgtttactaatacactggtaattatttctattcatattttattggccaaagcgagtcatatgggtatacaacataaaatgaggtgcagaatttcaatcctatcatttgcttggaaggtggagagtcatatttggagaacatgagttctataattgttggatgtaacagtctatacatgtccactaagtcaagtttgctaatcgtgtttaaataatctatatccttactcatgtatctgttcacttcttgcagttttgtcaatcttagttttatatttttgaagctatattatgtgtacaagttttataatcattgtactttctcatgagttaaactttttatcattatgataatgctttttgccttaaagtctactttgtctaatattaatatagataacattaatttttgttaatatttatatttttccactttttaatttcaacattataatacaaatgttttaggtatgtttcttataaacagtatgcagattgttatccaattcaatctttgatttttaattgaactatttaatttatttacatttaatgtaattactgatatatttgaatttaaatataccgtcttcttaagtgttttcaattgtctcacatgctctctgttctctttatcctcactttttgcctgcttttggaaaatattgtttttgcctccattgttttggaagttacatatctttttagtagtcttttagagtttatcctatagatcacagtatgggtctctgagttagcaaaggctaataatgttaattggcactttcattttcttccataatagtacaaggaccttagaacgtttcaattcatttacttcctctcctgatttgtatgcacttttaatatttttaattttttaaatcttcagcactgtgttacattgtttcatacggtataattcatttagacttcctcaaatggaccttcgtgctggacctcatttctttctgcatctatataacctatcatccttaatcatcttccttctgcttaaagaacatcctttagtatttgatgctggtaaagaatcctgaaaatgtcttaatttcacttttattattgaaggctattttcactggacatagaattctaatgttgacagttattttatttcagcacttgaaagacatttaaattccactaatttctagtttccattgtttctatcaagaggtaagctaacagtctattacattttttcaagtaatgacagctgcttgtaatttttttttccctttgtctttggttttcatctgtcttattgtgatgtacctaggtgtggcttttaaaaatttctcctgcttgcagctcccagggcttctgagatttgtggcttgttgtctttaatcaattttgggaatttttcaactattttctcttcaaatattgatgctgcaccattctctttctcttctccttctgaaattttaattctcattttatctccatatctcttactctctgtagcattgctatccttttgtctctccatgtttcgtcatgatgttgtcttctaacctactttccagttcatcaattttccctacagctgtgtataattttttgttaaaccaagtaaagagtatccactgagctctttgcttttgttagtatatattttaaattctaaattgttcactggttattttttacaactttttcatccttttttaaagttttcagttctctgccaaatttgttgatactgtcttttatctccgtatgtgtagtaaacataattaatttaaagtccgtatctgataaatccattaactggagttctgtggtattgtttctattgtagttgtttctactggatctcatgttttcttatttctttatgggcctggttattctcttgtgtgctaaaattgtatatgaaaaattgttggttgaagtaaagtaaaacttattgtgttatattcctcctgagagtacagtcatccctcagtatccacagcaggattggttccaggacctactgcagataccaaaatccatgcagatttcatttccacaatcaaccctgtggaatccatggatataaaacgtcgaccctccatatataagtgagtttggcatcctgcaactactgtcttttatatttatgtttggttgcagatgcagaattcaccaaagcctaatccagagcaaggccctaactcttcaattctatgaaggctaagagagctgaggaagctgtagaagaaaaactgcaagctagcaggggttggtttatgaagtttaaggaaataaaccattccgtaacataaaagtgtaagataaagcagcaagtgctgatgtagaagctgcagcaaattattcagaagatctagctgagatcatggatggcggtggttacactaaacaacagagttccagggtagacaaacagccttctattggaataagatgccatctaggactttcatagctagagaagagtgggctgactatatttattttaaaaatccatgtataggctgggcgcagtggctcacgcctgtaatcccagcagcactttaggaggctgaggcaggtgggtcacctgaggtcaggagtttgagaccagcctggccaacatggtgaaaccctgtctctactaaaactaaaaaaattagctggcatggtggcaggcacctgtaatcccagctactcaggaggctgaggcaggagaattgcttgaacctgggaggcggaggttgtagtaagccgagatcgcgccattgcactccagcctggatgacaagagcgaaattctgtccaaaaaaaaaaaaaaaatccatgtataaatgagccatacagttcaaacccatgttgttcaagggtcaactgtatttatatttgcttttgcaagatacctggggatgtgaggacctgggatcacctttatccaatttgaagaattaagctaattggatctcagctgaggccccacaaaatctcatctacttccatccaagtcatcctgtcttttctcttttttaaatttttttggaggtggggtctcactgtgctgcccaggctggacaacataggtccagtggcacaaacataggtcactgcagccttgcactcttgggctgaagggatcttcccaagtagctggggctacaagcacatgccaccatgctaccatgctgcgctaattttttcattcagtcttaagatgaagactttcagggtcctagcctgctatggggagttatatgtctaccctctcctttggtgagcaccggattccaacttgtgtttatgtggccacacaaagctgcccaggtgctgcttagtctcttcagttctttttttttttttgagagggagtctcactctgcactgtgtcgcccgtgctggagtgcagtggcatgatctcggctcactgcaacgtctgcctcataggttcaagctcctccgcctcctgggagcctgggtgattctcctgcctcagcctcccgagtagctgagattataggcacccgccaccacacccagctaatttttcttttgtattttaatagagatggggtttcaccatgttggtcaggctggtctcaaaccctaacctcaaatgatccacctgccttggcctcccaatgtgctgggattacaggtgtgagccaccacacccggccatctctccagttctttgttgtcgtttccagaagcagcaaatgtcccaaggggaaaagaggcccagttattgggcttgcctccttgaatacccatctttctccagctcttcattggtgattcttcattatctttttaagtctgatgttttcaagcacattttattttaattttttcccacttttctaattgttctcagcaggacagtaggtctgaatttagtctgctattaccagatggtaggaaatagacaggtatgcttcattttgtcatagtttgctttactacactgcagatattatattttttacaaattggaggttcgtggtaaccctgcattgaagaagcctttaggtgccatttttccaacagcatgtgctcactttttgtttctgggtcatattttgataattctcataatatctcagactttttcattattattatatttgttatggtaatctatgatcagtgatctttgagattactcttgtaatcattttggggtgccataaactgtgctcatataagatggtgaagttcattgataaatgttgtgtgttctgacttctccaccaatcagccatttcccatcttttacattcttttcagtcctccttattccctgagacacaacaatattgaaattagactaatcaataaccctacaatgtcctctaagtgttcaagtgaaagcaagggtggcacatcccacactttaaatcgaaagctaaaaatgattaagctcagtgaggaatgcatgaggaaaagccaagagaggccaaaatagagggcttttgtgccaaacaggtagccaagttgtgaatggaaaggaaaagttcttgaaggaaattaaaagcactactccagtgaacacacaaatgataagagagtaaaacagccttattgctgatatggagaaagtttgagtggtctggatagaagatcaaaccagcaacaacattcctttaagttaaagcctaatccagagcaaggccctaactcgcttcaattcaatgaaggctgagagaggtaaggaagctacagaagaaaaattagaagctagcagaggttggttcatgaaatttaaggacataaaccatttccacaacataaagtgcaaggtgaagcagcaagcgctcatgtagaagctgcagcaagttatccagaaaatctagctaagattatggatggtggtggctacactaaacaatagaatttcaatgtagacaaaacatctatcagaataagatgccatctaagactttcatagctaaagaggagaaagcaatgcctggcttcaacgcttcaagggacaggctgactgtcttattaggggctaatgcaactggtggctttaagctgaagccaattgctcattttccatacagaaaatctttggacccttacaaattatgctaaacccaggccagacacagtggctcatgcctgtaattctagcactttgggaggtcgaggcaggcagatcacttgagctcaggagttcgagactggcctgggcaacagggtgaaaccccatctctacaaaaaaatacaaaaactagccaggtgtggtgaagtgtgcctgcagtcccagctactcaggagggtgaggcaggagaatttcttgagcctggaggctgaggttgccgtgagtcaagatcacgccattgcactccagcctgggtgacaggagtgaaaccctgtctcaaaacaaagaattgtgctaaatctattctgcctgtgctctataaatgaaataacaaagcctgaatgacagcacatctgtttatggcatgtttactgaatattttaagcctaccgttgagacttactcctccagggaaaaaaagggattcctttcaaaatattacttcttgttggcaaatgcatctagtaactcaaaagctctgacagagatgtacaaggagagtaatattttcatgcttttaacacaacatccattctgcagtccatggatcaagaagtcatttcaactttcaagtcctattacttaagaaatgcattttttaaggctatagttgtcatagatagtgatttctctgatggatctgggcaaaatcaattgaaaaccctctgcaaagaatttaccattttagatgcccttaagtacattcacgattcatgggaggaggtcagaatatcaacattagcaggagtttggaagaagttgattctaaccctcacggatgacttagaggagttcaagacttcactagaggaagtcactgcggaggtgctggaaacagaaaactagaattagaagtggagcctgaaaatgtgcctgaattgcttcaatcttgtaacggttaatactgagtgttcacttgattggattgaaggatgcaaagtattgttcctgggtgtgtctgtgtgagcttccctagttttgaggttttgggacttggactggtttccttgctcctcaggttgcagatggcctattgtggcacttcgccttgtgatcatgtgagtcagtactccttaataaactcccgttcatttatacatctatcctataagttctgcctctctagagaaccctaatacaaatttcatgataaaacttgaacgaaagaggagctgcttcttatggatgagcaaagaaagtgatttcttgagatggactctactcctagtagagatgctgtgaacattgttgaaatgacaataaaggatttagaatattccgtaaacttagttaatacagaagcagcagcatttgagaggactgactccacttttgaaagaagttctactgttattaaatgctaccaaatatggtacagagaaatattttgtgaaaggaagagtccattgacatggcaagcttcattactgtcatattttaataacttgccacagctacctcaaacttcagcaaccaccagtctgatcagtcagtaaccatcaatatcgaggcaagaccttccaccaggaaaaagattataactcactgaaggctcagacgatcattactatttttttagcagcaaagtatttttaattgaggtatgtacatttttagacataatgctcttgcacacttactagactacagcatactgtcaacataacttttataggcactgggaaccaaaaatttgtatgattcactttgttgcaatacttgccttactgcggcagtctggaaccaaacccacaatatctccaaggtccacctgcaaatgcaggcagtgggccaggtatacatgcatacatatgccttatgtgaggggtgggcactgaggttaactagaaagcatgagcctatttttgccttgtggtaataagggcctcatattgccaaatttttccatttttttcaaaagaagtaggaaaggaaatgcaggcttttaaaatgtgaaatcccaattttcaattgttggttcaaaaaaaacttaaatctcaactagccaaataaaatgcatctggggtccacacccagctaccctataggatactaatttaaaatatctggactatagtctatattgatgagagaagtggggtgaaacttggcattcccttgccattaacttctagcctcccagtagtccaggctgccttgaataaacaccagaccatcatacaaaacagagtttttatcttatttatttatttatgagttgggtgtcttgctgcattactcaggatggagtgcagtggcacaatcatagttcactgaggccacgaactgctgtgctcaagtgatcctctcacctcagcctcctgagtagctgggactacaggtgtatgccaccacataaggctaattttaatttgtttttgagagacagagtcttgctatgttgcccaggctggtcttaaactcctggcctcaagcaatctttccaccttggcctctgaaagtactaggattatagaagtgagccgctatgcttgaccaaaacacagtttttaaatcaatttatgtctttactgaaatctcttaaagatgccaaagggtggggtttgggttccattcataacaccaacatttctgaagaatcctcttctcttgtctctttctcaagtcctcctcatgacatctgtgttagtccgttctcacactgctatgaaggactgcctgagactgggtaatttataaaagaaagaggttttaattgactcacagttccacaggggtgggaaggcctcaggcggaaggggaagcaaccacatccttcttcacatagcggcaggaaggagaagtgccaagcaaaggggaaaagcctttcataaacccatcaggtctcatgagaactcaagaagagcatggggatatgtggaggaaaagttaaatcttaaatttgaactcaattgaatgtggacacaaacaatggtcaccaagtcccagaacaggttgcatgagccccttgaggcgttcatccagacggttttggagaaatctgttcctgtatgttagttattgaaaaacaacaaacaatcataaaaacaagttgacctttttgtgttccttgagtccagtcatgaagggccctcgtgactgggcctcatgccaaataagtcgttacaaaaagaactagggtcccataccacgccaaagcttcatgagacctctcctcatctgtgcatggatgagcggtcaactctggagcccaggctgttgcttccctgtctggtgatgaatcctctatagtctggtaagtgtagtggccgactctggagcccaggctgttgcttctggtctggtgatgaatcctccatcgtctggtgagtgtgtgtgtatatatatatagtctatattgatgggagaagtggggtgaaagttggcatgcccttgccattaacttctagcctcccagtagtccaggctatatatatatatcttctcccttttccccttcccattgcaatttgcttgtatcatttgcttattatatctgcattgccatttacatgggataaaggttgtttacccttgaaggtattgcatgtgtgtcttttcttttccctttgtgcatctccctcatagaaaagagtaaccgcccccatgattcaattgcctaccactgggtccctcccacaacacgtggggattataggaactacaattcaagatgagatttgggtggggacacagccaaaccatatcaacagcccagcagctacttcagtcctccttaatttatctcttgaattctcccaaacccagctcatccctggcttgtttctcttattctttctctcgccttctgatccattctgctttcgttagtatgtaactccctgccttctcttaggtagacccatcaacccatcctacccatggtactgcacaattcagaatcctttcccaaattttcccttattatgcacaagaaatactccagggccaggtgcaatggctcacgcctgtaatcccagaactttggaaggctgaggcaggaggatcgcttgagcccaagagttcaaggctgtagttagtgatgttggtgccactgcactccagcctaggcaacacaacaagacactatctcaattaaaagaaaaaaaaagaaaaaagaaaaagaaatactccagaacttggctagtgaagactaattcctccttcacaggaaggaagtgggggcaggggaaaatgatgctgtaaatactctaaaatatgtattttttcctgtcccatcagctatgccatctgggatggggtgacgcctggatgagatgtcattttaaaggacatttctgggacatgctggcatcaaggcaagttttcaggctggaagccatttgggcagaggcagaatctgggctcagagtctagccctgcaggacccagtgtggcagctgcgtgtctctggagcactggagagggggctactgcaaattaagatctgctgtaaagagcatcttcctggttattctctgggacgcaaaaccatggtggtatctgatctcatcacacttctgccaggaggtgaaatcgaagaggctacattcttgatgctcagtgtcttcttcaggtcatttgcctgaggacacctggggatactgagccctcacagagcttccagtcctccatgaaatgcagggttgccgcctgaaaacagaccaaagggggcacacgacatggttctgacagcatgggtaaatacaaggaagctgggagccgtgcaatgctgcacacgtcccctccccggcttcatctcccattccctcccacccagctgctgttgcagggccccctgccttctttttcactctcaacagcacaccctcagtttgcccttgttttcatttccttttccccttacctcccatacctcttttccaatctctccccctcccgttctggttttgttgtaaatcacaaaatttcaggaacaggcccagcaaggacagaagccccaaggggcaggggaaaaggagagaaactgcatagataagaacaggcttcttctcagagtaaagactaagaagacacagccgtactgtaatagtagttacccttgtccgaagggcagtgcaagcctggaaaagggagaccacccgtgggctagggagtggggaagaagctcattagggtgtctggacacgagctaaaccttcacagggcacggggacttgggaaagcagaggggacggagaggccatgccagccc

SEQ ID NO: 779 - DNA, 2529 bp, Homo sapiens
tcatgatccacccgcctcggcctcccaaagtgctgggattacaggcgtgagccaccgcgcccggccgagtccaggatttttaagggcttcagaagggaagaagtgcatgccgattggcccatgggcagccacgggcaggccagaaaaagcaccataagttctcactctgggccgcagacttcacccagaactgacagctgggcccccatacttcaggccatccctggcttgaaagtggtgcttcaccgggacctgcccctttctgctgagaagcctgtctgcctcctgccaccatcaatcatgttgtccatggtgcccaggctgttcctgcggaggagctcctgcaggccccaccaagccaccctcagcccctgtggcctccctcccgtgctcgattgcacccaaagtccaaatggagccaaagtagcatagggctggtgtgtcagcaccgccccaagcgcacgcaaacctggccgagtggcgatagtgcccaggctcagcctcaactttactcggaaataggagtgggcgccaggagcagggagaagccaggaagcgggagcaggcacttctgagcctgcgaagacagggaggcttccccggctcaagagcacagggatgcctgggtctgcagcctcggctctctgttgcagttgtgcctgtgagggctgggttcccaccccaccaactcagaaggggccagggctcccgcctgttcccagctcctgctggctgcatggaactgcagccctggccacgcctccctccactgcaagccgcatcttcaaagcggccgctccagacaggctgccactgccatcaactgggacaccccgaatgcttacccgaagcagagagattataataacacagctctactgggacaagtaaaagcagacatcgtttcctctacataatccaaaattagaacatttaaagtgtaagaaccctgaattcgtgtcctttttctgctactcattagccctctgacttcagtttctcctttttaaaaaatgggtaaaataatgtacctcccagagttaaaatgaggtagatccccaggggcatctttcccacccacctatacaggtgtggaaaggaggtctcaggtaccagcagtcagtcggcagcttcaatctttatgcttcaaatagcattgatgttggtgccatgagaaatcagaaatgatgaagatacagtatctgtcctcaacaagttcagaagcagaaataggagctataaggaaatcatccctaattcaaatcagaaagtgaggtatgccaacacagtagtgtaatcctaatctttattgtgttagaaagttcctcaagacgtagatggaagtccataccccaggagaattactcataaaaatgaaatttcctgttttcaaaaatgacacatatggtataaaagtggaaccacacatggtgatcttactaccctggggggtgctatgtaaatgggccagggatggtgtctggacattttcctaaaattgctcctatgttctttatttcttcacaggcagattagggcctttagcctaaagcttgccaataccaaattcagattcttacacaaccaattgctttaaatattaaaaataaaatccaaatatctttaatttatatttaagtcttaaaaatgcaaaatcttttttaaaaatcaaagtaagcatatatttagccatttagaacctacctactttgcgtacctcacaaaactacacccaacatctgcagaccatagaggagacaagccctgcagctgctaaagaccccagacaggtgctgcccttcaaggctgtcagagcccccaccttgctgctgcgcaacgtgatgtagacaggtggtccctctttggttcccctctcccctgggtgaaggcgtcacaccactgtctctggaaggtctcctgctggaagaaacttcccccctcacataaccctgtccacgcaccacccaagaacacttgttgtgtatttactgcctctcacagtcgtatttcttccttgatcgaccctgaaatccttaaactggccatagagagcaaccaccatctaatggaatatcaagcccttgccaaatggaacacagtttttttgggttttttgtttgtttttgagacggagtcttgctctgtcgcccaggctggagtgcagtggcgcgatctcggctcactgcaagcttttgaccttctcccctgagtctacaaatgtccaagagatatttcttctatgatggaaatattatatgtctgtgctatccaacatggtagccactatcaacactgaggacttgaaatgtgactagagcgactgagagactgaatttgtagttctatttaaatagtcccatgctaccaaattggacaacacagctatatataatttgtacattcacatgctcctatgctattctttaaccatactggttagttttccttgctctctctcaactacagctaaattcctctcaagtcttagagcttttagactaggagcttaaccagtttaatttaaataac

SEQ ID NO: 780 - DNA, 2280 bp, Homo sapiens
gagtggctggacttgtgtgaagcgaaggggttgcaagacgctcccccttcccttttcttttttattgggggtggtggtagtgtttgaggacattgcgtcacctctcttcggggtggagggggggaatctctgcttataggagtgtattttgtgaggaagaaaacccataaaatatccacgaccttgcagctgttaagaatccagacttttcagtcccagggcggggctgcctttccccccatcccgctccctttctttggactaaagggaaagccttcctttcctggggatgggacgcccgtttccactgaaagtgaaatcactgtgaacaacctgaaaattggaaagttggaccagctgtggggagagaaaggtcttcgtgtcctttcccacgttcaccgtgccagttacacacaaagcagagatttttttgcttgaatcattaaaagccgggtgggtggggggcaccctatgtactgtcttgccctccttcggcccctttctcacatttatttgccattttctttttgctgacaagttccattacagaatgccccctccatcccccgccgccagattttttatatttcaattgttatttactccaagagtgtggaaagttctcctttaagattcccccgccttgaactctaaactcagagtggaaagggaatctgaaaagtctctcatttagcaacacatcacatcagtcctttttgtcagataaacacaggcacaattgcttttaaagatcttcagaaggaggagtccaccacttccacagtagatccagagagacccgaactgaatgctttgccttctccttgtgttaggagttcagaggttccatttgctttaaaacacaagaagctactaataaaatatatttatttcggcaaggtacctattttctccaaaagtttcaccttcagtaattgccacaggagtaattagaactctgtgttctataaaatgcctgacacattaaagacacaaaattagcatttgtttttattcatgcaaggatttaaaaccaaaccaaaacaaagcaaaacacccagcaaatatcagtttcctacaaatagtgtaaaaaaacctcttgaggaatctttgtgacccacactccaaattgaaagagtgccatggatttccccaaatttagaatcctgtctgggttagaggatttttttggaatttctcatcacttgacaaaacagttttctcttttcaaatataaaagagctccttgtaaaatgcttggtaaatttctgggaagccgagtgtttcttccagagggaaggatacctggaaatccggatgtaagcaagataaacctgtagctaaagctttcttaaaattcattgattctgggggaaggaaataagtgattagaaaagtatttggtcaaccaaaaccatgatagtttgatatatttactgcactgaaaatacactagaatcatatgcatagtggagcttgaagtggaaagcccaccttacattttggaagaaacttttatatttcaatcccatagatatctaatttatttaaggaaacaggatatctctgtctcataagaaaaaaaataacatctgactgatttttataggaatgcttgggagtttactcttttacttgaaaggttttttttttttttgcctttttttttaaactttagaaacagaggcgtttcttagttaagataacagggcttactacagtattctttaattatcaaggtcccttgtaactctaagtctgttatctctaattggagagataattaaatcttaaagaccactctgactctaattcaaccaacgtgtgtggtgtccaggatcgttggacttccttaagaattctattttatccaggtgggttcttcctcagtaaattgtattctcctattggtaggaaatactcttggatttctttctttctttctttttctttctttctttctttctttctttctttctttctttctttctttttccttctttccttctttctttctaaaactgtattcagagagagaaatgtgacaaaaaaagggaaatcaatagagacagaaagtagattcatgggtacccaagtttatgggctgggaacaggaattaactgtaaaagggcacagggaatcttattgaggtgatggaaatctgtgttctaaaactacattgcagtgatgactgtacaatttggtaaaagcttcaaaattctggggattatacacaaaatgagtgaattttacggtatgtaaattatgcttcaataaag

SEQ ID NO: 781 - DNA, 986 bp, Homo sapiens
tttgcaaatagtaacgacaaagatgatcaagttttaaattgccatttggcagtgaaggtgctatccccggaagatggaaaagcagatattgtgagagccgctcaggacttttgccagtgagtagcccagaagcaaaggagacccaaagatttggatgtagatatgttagtttactcagttcaaatggttgtcctgatcctgatttagtactgaagttcggtcctgtggacagcacacgaggctttcttacctggcacatcagattgactgagattgtctctttgccttcccatctaaacatcagttatgaggactttttctctgcccttcgtcattatgcagcctgtgaacagcgtctgggaaagtcgtggtcattggttgcataattccatttgaggcttatggaggaaaggacccaagtgactctgatgtttagaaagcacctatgaaaccctgtacacacctagttcataatcttcataatttatcaacaaacaaaaaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctgttttcgtggggagaagagggcctgattagaactgttctggttgtgtttggcgggaggggaataaattttgttcagtccttcttagtgaccaaactttaatttttaagaataatatattgacttactgaactgaagcattctgagttgaaaggagctccagaggaaaggagttctgtgttgctcacatgttaaaagcttgctcaccttcagagcagagggaatacctatcttcagatatccgcccattttcatctcttcattatagtcaaacagtgtgacttgagagtgttg

SEQ ID NO: 782 - DNA, 5178 bp, Homo sapiens
gggttccgaggcggacctggggagcagaaacccctgtttagggtgaaccgtggcgggcgccgatggcctcttggaagaggacagactagcagctgcgagggagatgggactgggtttcacccctgaaagggcccctggagacagcggggaaactgacagggagatcatgatgtcgccattttgatggggtccccagaggagagatgtcctccccaacggctcctggacaggactggggaaagagttcaggagggctgctgaacgccggagccttacaactgttaaactcaggcagagctcgggaaatgctgcccggatgggtgagtccttttaacacctcttgggttgatttttctcacaggttttcggggtttgcagagctctgagactgtgaccacagggtgagacctcaagctgcccagtactgtggccccatttcagaggccttgggcctgggccagagatggacgctggggctgccttttactccaagtttttttcttcattggtcattggtcattgggctccaagaaaagcactttttcaggaatcaaagaagcagtgatggaacgaaaagcagagaaagctgatgagccctgaatggaggtgaaacttccaggaaatatcacttgcctcttgattaggggaaatcacttttgaatgaccccgagttttgtgccccaagcatagattctggcagaaagaaacagtctggactgatgacacactacaacatttggtcatgtggaaagaatgatcttcaggaaaaatcacacccttggcaaaggctttttacagaggcaagggcgagccggccaattctgacaatattccagtggcaagggagccaggctgactcagtcatcattacttgtgtttcgtctcttcctcccacatctccttgtataactgtcttttggggaggggtgaagtgatagtaagaaaaacaacagcactttgaaaaagggacagggggagaaacaagaaggggagaaagagttggggagagctcttgggtgatggggagatagcactggggatgttctggagcctgacagaactgtgtggtccctccagctggagatgctgggaaaacaggaagggattcgggagacggcagggatgaagttggctcatgaaatgcagggctcccttagcactttacaaataccagcttacaaacactccacagtcatcaggaaacccttgatggatgctgcacagagatcgaagttcaggagcagcaccaatattcatccggggcaattggagtgagagcagcacaggatcacagcctgatttggcctcagaggctttcttatctcttgcaagatctggaagccatgcaaaaggtgtcatggggagaggcgctgatgtcaggcatttatgggaccactgagtgggggcaaagaggcaggagaaaaagccagtgatgatgggtcgacacctgcaggtagacccatttgcaggttattagaaactagcttatttatccagcttttttttttttttttttggagatggagtcttgctctgtcgcccaggctggagtgcagtggcgtgatctcggctcactgcaacctccacctcccaggttcacgccattctcctgcctcagcctcccaagtagctgggactacaggcatctggcaccacgcctggctaatttttttgtatttttagtggagacggggtttcaccgtgttagccaggatggtcttgaactcctgacctcgtgatccacctgccttggcctcccaaagtgctgggatttcaggcgtgagccaccgcgcctggtcctccagctctctttttgtggttatcttagacgctatgaatctacttgaaaaccaagacgattgatcctttaagtgagctgcaggtgtccacctgggcgtgttttctgcttctaagccacaggcaattcggtgtgcaagtttaacaccctgataggccctagccttagctctgttttaaactcccaaaaagtgtttttgtgtttgtgtgcatgtgggggagacaccttaaaatccagcaatgctgtgtccacagtgctctcctgggccccttccaaagatgggaataatatgggcagctggtttcgatttttataacttgcaacagctactctgtgaaagcggtgtgcagcaacagccaggcaatccggacagacttattaaatgtgctgggcactgggcactgggcactgggcactggaattctcctggttgtaggcaagctgggggacagggaggtgagagctggaatagtcattctgaagtgtgatatttattggaccccatactaggtgactgatggagaggggctaccactcttccagctaaactccgctctggttgggacccagcaattattttccatagcgaagtgttaataaaatatctgttactcccaacacaacctcctgggggaagggacctgtctgtctgcttcaactttggatcctcagtgcccacatcaggatacctggcctgaggtgagtgctgtagaaatagctgttgaatgaatgcatgagggcctgctctgcctgagggctggggacagattgggtgttttctgtgtcccctccagagcatccggtgacccagttttaggtctcaaggtcactgccaagaaagagaagctgctaaagtgacacctctgtgcacccacatgacttaacacaaaagttaacaggagctcttcaaaaacaagcctctcgagtgtctgtctcctgttttccctgaggacagcatcagtggcatcagataggggttggggctgggtgacctgctggtcctcagccatcactgtggcccagaggtcatttaagcagctctctgcttagcagacaggcagagggaatagatggaaggtacaggtaaacactgcatgtggccaccgcgaggataccccggagcctgggaaacagacagggacgtcgtaaaaccaacacataatggaccagtgcagagacaggcaaaaccagtcagaagaaataggatggtgcctagcccagggacacctgacttaaggtatttttgtttgtttgttttgttttttgagacaggggtctctctctgtcacccaggctggagtgcagtggcatactcactgctcactgcagtctcaacctcccaggcttaagcgatcctcccacctcagcctccttagtagtagctgggactacaggtgtgcaccaacacatccagttcatttttgtatttttttgtagaggtggagtttcgccatgttgctcaggctggtctcgaactgggctcaagcgatctgcccgcctcggcctcccaaagtgtggggattacaggcgtgagccaccacacctcgttgacctaaggtattaactaaagaaagcaggtgattctcaggggggctatgaaagcagcatgcctaagggacaggaacgtaccatgaaggtgttgtcttttgaggctcagtccaggagaagcaggtcttttagacccaatgacaacgctccctagtgtgcaggtgcgtctctctgatgacaaaaggcagtgtgattgtgatattttatatatatatagtttttgttattgttgttttggggacaggtctcactctgtcacccagactggagtgcagtggtaagaatacggctcactgcagcctcaaaatcccagtttcaagcgatcctcccacctcagcttcctgagtagctgtaactacaggcatgcaccacctggctaatttttcaaatttttttatggagactgggtctcattatgttgcccaggctggtctcaaattcctgggtttaggcaatcctcctgcctcggcctccctcaatactgaggttacaggcgtgagccactgcaccaagcctatattttgttttttgttcacggttcctggcttataactcccatggcccttgttacagtaaacacgatctccctccctgacattcttctaccctcctttcacctgcccacagcaggactttaatctgattctgcgtgtaatctcattgcagagagggtcctgccggtattaccctggaggaaggaatgctgcacagaggccgagaggaatttgaacagactggccttgctgggtttttatctctttttgtccaatcccattttgacacagttgtccatgctccaatcatgcttatccaatgaagtttccataacaggcctgagaggacagggttcaggagcttccggacagctgagcaggtggaggttcctggagggtggtgtgccagggagggtgtggaagctctgccccttcccccataccttgtcctatgcattcctttatctgcatccttcattttattttatttttttttgagacggagtcttgctcttgtcgtccaggctggaatgcagtggtgcgcgatcttggcgcactgcaacctccgcctcccgagttcaagagattctcttgcctgagcctcccgagtagctgggattacaggcacccgccaccatccctggctaatttttgtatttttagtagagatggggtttcaccatgttggccaggttagtcttgaactcctgacctcaggtgatccacccacctcagcctcccaaagtgctgagattacaggcgtgagccacagtgcccggcctgtatcctttataatatcttttataaacaaccaatcagtaaatgtgttactctgacttctgtgagctgctctagcaaattaatcaaatccacagaagggtcatgggaaccccaacttgaagcctgtccgtcagaagttccagagtcctggacttgtgactggtgtctgaagtgggcaagtcttggggactgagcccctagcctgtgggatctgatgctatctccacatagatagcaatggaattgaattggcgggcacctggctggtgtctgctgcagagctcattgtttgcttagtggtggagagaagtctccctccacatgtggtcacagcatcttctgtctgtgttgattgcttttgatgttgatcgagagaacaggaaaaagcacattgaatgtctcaatgatgaagatgacaataatctggcttctaggttgttatgcggcaggcaacagctgtgcagatcctaataatctactctgggtgacagtttaacacaggggttggcaaatgtggcccacttcctatttttataaataaagttttattgaaacatg

SEQ ID NO: 783 - DNA, 4177 bp, Homo sapiens
gcgaccgccccgccgggaggccctgcacgcacgcgccgccggccgggccagattagtgtcatctttgatcactctatctacatccaagttatcaatatcccttcaatggcacagcactcaggacagcactgccactaaagatgccaccatctggctatgctctaatcgggcatatgtgtcctcatcccatctgcagagggtctacaggggcttgcctcttgttgccagcactgcctggctctgcagcctactcaagaaaagaaaatgaaagcagcctgactccattcgtcatgattccttcttttccttttgaggctcacagacagaccgttggccagcctcgcccaggactgacgtcaagttcatcttttgcccttgtttgggctgggtcctctggcccagcgatggaacacttgtgtaccttcacctggtgccctgggctgctccagaccctggcctctggctgtgccaaagcaggaaggacagactcagggtgttgcctgtttgctctggtggggagaggctaagaatcgcagtgacgtagggagagaagaaagatggacccatgtggcaggagattgtgctcagggtagagtcagcaaaacactgacaagattccccaaaactctggccagaaagtgcctgagatctccgtttttagattctgttctttaaagatacttcatctgtatgtgtccttgagtagaaggcaagttctccttgaaggggacacgtttctctgctgtcatcttaggacaacttctttgagaaggagactctagttcctgcagccatttgagaagggggctggaggggctgagccaggaggttttgggggtgaggcccaggtagaactttgtggcagggagtgctggggtgtgcacccacatgggccaccccacaagttgatggggaaagggggcaagtagggagtacaaggatggaaggggttctcttctccccacccactttgcctggctgactcccatttgtccttcatatctcagtttcagcaccaattcctcagggaagccctgcaggcctcagaacaagtgagatccccctgtcattccctcccagagcccacactttttatccatagctcttaccacagttacagttaaggctgtcgcaaggtgtgcgggtatctcgcctccatccacgaactctctgtgatggcagtggccaagtctatctgttcaccactgagtccgagcacccagccctgggcctgcacacagtaggcactcagccatatggagtgttgtatgaatgaatacatgaatggaagaatggacaaatataactgggaggacacagtgcagaggcactgcagccccttctcatttttcgctggcctagttggacacagaggacttggatgaccagaggagggacgccacctggtggtaagagtgtggagtgagcattgagttcccttctcaaaatttgcctccagtaaacaaaataatcctgccttctagtcaaccctatcaaagagctgagcatcagggaaaaactccgatctccaggaacaaatgacaaaaaaaaaaaaaagtagaaggcactgtttccaaatggagcagaggaactgaaatccaagttagagacatgatctataaacacacaggaaagcaaccaaaagaaagcttggatttgctcatcatttcatctaaatgtagtgataataataatgactttccacttactgcgtaatactacgttccagatgcatgggtacactgtgctgtgtgctgaacatatttaatctcctttaattctcagcaacaaccttataagggagatattactatacccattttatggggaacaaatgtcagttcagaaagtttgagtaactcccaggatcacacagccaggacctgacaagctgggatttgacttcaggtctgtggactctgaaactcatgatattaaccattaggttagacacctgatagatatggccattcaacaggttgaaagtggatctcatcatctttgcttctcttcctcctccacttcacacctcagcgaacagcacaacctgtcctccccacacctatccagttgaccaagccagacatccaggcaggtttgtttttgtttttgtctttgtcttatgtttgagacagagtctcactctgtcatctaggctggagtgcagtggcaccatcttggctcactacaacctccacctccagggttcaagcaattctcctgcctcagcctcccaagtaggtggggttacaggcacccgccaccacacccggctaattttttatatttttagtagagagggtttcaccatgttggccaggctgctctcaaactcctgacctcaagtgatccgcccacctcagcctcccaaagtgctgggattacaggcatgagccactgtgcctgtctcacccaggagttttgataccacacctaatcactcaccaattttgttgattctctctcataaattcacatttttttcctatgctctctatcctcactgctgctgccttagttcaggccatgcccatctcttgcctgattagagggtctcccagcagtccctctgcttcccagcacatgtgtgattatttatttatttttatttatttatttattttttgagacgaagtctcactctgtcactcgggctggagtacagtggcacgatcttggctcaccgcaacctccgcctcccgggttcaagcaattttcctgcctcagcctcctgagtagctgggattacaggcacctgccactatgcccagctaattttttgtatttatggttccacaggctgtacaggaagcatgatgctggcatctccttggcttctggggaggcctcaggaaacttacaatcatggtggaaggcaaaggggaagtaggcacgtcttacatggctggagcaggcagaagagagggagcagggaggtactacacacttttaaacaaccagctctcatgatcactcatttactcactatcacgagaaacagcaccaagaggatgatgctaaacattcatgaaagaccatccccatgatccaatcacctcccactaggcctcacctccaacactggggattacaattgacatgatatttgggcagggacacagatccaaaccatgtcatccctttaaagaagtaattaaggctggatgtggtggcttatgcctctaatcccagcactttgggaggccaagggaggatggcttgcagctaggagttggagaccagcctgatcaacatagcaataccatctctaaaaaataaaaagtaactaagttaaagtacagtcatcagggtgggccctaatccaatgtgactactatccttataagaagaaattaggacacaggaaacagagggacaaatgtgaagacatagtgagaaggtggccatctgcaagccacggagagaggccccagaagaaaccaagctgctgacatcatcatcttggacttctcgcctccagaactgtgagaaaatacattttcgttgcttcagtcacctagtctggggcattttgttacagcagccctagcaaactaatacaatcaagaaaggaaatcagactcagcaaggctgagggacccacctagcgctgtctagctccttagtaatgcattcatcacattctgcctgtgaccactctcttatgttgattatcagataaaataatggatttaactcttattatttaacttcttgagtgtttgggtcttattgctccaactggcactcagggtaaggggccttgtcttccccttctcagtatttgcagatatcctagctgagcttggtgcatcttaacaataactttttgatgcatttcttgttgttgttgtgtggttgattgacacatttggatgggtaaaaaggagcctgatggctgggcatggtggttcattcctgttatcccagctgcttgggaggctaaggtgggaggattgcttgattccaggagtttgaggccagcctgggcaacatagcaagaactcatctcaaaataaaagtaaaaattaaatttaaaaggagcctgatggtaaattcctgatccccaagagacacatacaaaggtaaattcctgatccccaagagacacatattctgccagtgatcacacatattcccagaagtagaatatgactcatctctgaatgtctaaata

SEQ ID NO: 784 - DNA, 2672 bp, Homo sapiens
agtcgggcccggagcccggaaggagtgccccgcggagagtcgagcttccttccccggggctgggggttccgcggagctcgctctgggctgtggcgttgctcgcccgcgagctcctggggagttcgggggagctgctgggctggtgcctggagcgggggccgcctccaagtattgtctttcgaattaagttactgtcgtctgtgttgtcaggcaacaactgaccttaaataaaaatgaaaaccagaagtaggctacacatgcaataggctacacatgcaataatggatacttaaggaatgggagtggctgctggtgactggagcagagagggtgtggtttccccatgtttcggggccggggggaaggagtaaagtctgtgttcagagcccagacgccatgtcggtcatcacatcaccgggagaactcgtggagcctgaggaaaggctacggggtgccagagtctgaaggggcggaagattgcattcctatcacgttcgccgtggcgcacaggggctccgctggggccgccgctcccgcaggagaagtgggcctgagacggtgcggcgtcgaccatagccggcccagcagaagccggggaaggccacaagtgtaactgggtccgagtactgtgaagaaggcgcctcccatggagaaagctaccgggtagtttaacaaggtggaaaagcgttggcctggggaggaggaaaggatgctcagaaagttgcctcaaaaggacgcagaagtggaggtgaatcttctgtttcagaggcatttttttgtgcctctgtgagaatgcattgcttcctggttgatccatcttcaggttttctctccgtcctagtccctgttctgccaccattctgtgtttgaatctggtacctaaagccgcagatacttggttcatagtagatgtccactctgcagtggctgaaaacacggaagaaaaaccatctttgcctgggaaggacattattgctagtgccattactgtcaacagttggaacaagataaacggcatgcccaatctagttgaggattttggacaccgggcctcccactgggactccgccgagaaaccaggtctgccattgccacctccgccgggccttgctgtcttagcacaacggagtctcgctgtcacccaggctggagtgccattggcgtgctctcggctcactgcaaacttcgcctcctgagttcaagagattctcctgcctcagcctcccaagtagctgggattacagcgcgctcaggaatatatgttgaaacacagagaaggaggagactgacttcgaggagatgcacaggaagatggccatgtggagacagaggcagacattggagtgatgctcagaagaaaaggcactctaggagcctgcagaagcctcagagagcaacaaagataaaaagaggcctgaaccagcagccttcattacaggcaagagtactgtgtccactgtggcctggacaactgtcttcttcatgctccaccattattgcacagaatcaccactgtcatagccagtcagtcacagggcatccagcagctgctgcaggttgagaagcaggccgttgagaaggtgtcagaggcctgcagccaaaagaaccagaggctgaagcaggccaaagtggcagttcaggctgaaattgaatagtgccacctgcagagggagaaagagttcaaggccaaggaagctgtggcactgggaccccaaggcagctgcagcacggaagtggaggagacccaggataaaatgaccatcctccagacctactttcagcggaacagggaagagggtgtggataacctcttggcctttgcggcatccagccagaaattcatgaaaactacggcataaatggataggaggagaagcgcctgttccatggactggcattttagctgccctcatgaaataagaaactttagcaagctctagttatattctaatgagaaggcatttaattatttctgtatgttgtatagttggtcccttcactttatggagagcagcaaatccagtttcttgtgcagacatagaactaaatgtgtcatccttttacttcatgtttcttaggaatttaatggttatgtgctgtctgttttcctatgccttttggctcaagtaacatatagcaatgttgactttttcttttttagatctagtaaaacaacaacaacaaaacaatctttgaagaaaggaagggattaagtatttttcctctaatactttcttgaaggtcaatgaaaaagtggtaaatagttatatgtaacctgtgtgaagcagcagccagccttaaaggagtccattccttccaaggcttagaacagtgactactgctgtaattgcttaggctgctgttagtttctcttaatcaaaattactatgtgatagaattcatgttattacttggtgtactgaaaataatttaaaagtaaagactctgtcgtgcaagaaaggaaaaaatgagaggcaaagaatgttaaaatagaaaaaatgtttttatgagagagttaaccttttaatggcaactatatgtgaataaaattaaaccatcacttaaaatattcattagaatgaataatagaataaccaagttcataattagtaagataaaatatattgttgttttttcgttattttttaattcatattagaatttctgtcagt

SEQ ID NO: 785 - DNA, 3569 bp, Homo sapiens
aaaattttgttcaaaactatttttcgatgtcccatgccatatcagaaaaatagtgcatgttttcttgcctgaaatggagaaaactctccaaattgcttttaaataatgtccaatctcaggccaataagcactgtattaagtagtaacagactgtgaggagacagagagagacagagactcagagacagagacagagattctagaatatgcaaagacaacaaattccagaaggctattacaaaatggaagcaagaactaacgtctgccaaggtagatcatctgaatacctggactctctaaggaatgctcattgtgttaggtctctttttaggaaactctgtggtgttgagataggccactgggagttctacttgcatgattttactctgacatggtgggccgctattcaggcagtgtcaacatacttgcagtgatggaagatgtttgggtttattctgagtggaaaatgatgtatttttgtttgtttgtttgtttatctgtactttggaagtcctgattgaggagcctgaagatatccacactgagcattgatctgtgcatcagtaagtctggatctaaagaggaagatccacactggagcacaggtcttctacaatgtagtcatcgtgccctgtgtgggggccaccatgggatgggccccaagaacatggtgtgaacaacaacagcaaaaatggtcttgacctcagagagttcaggtctactctgatgggaaagaaaatattacacagtgcccacctttccgatggagctgaaggagacggagtcagagggacttaaaacagtaacaacaacaacaaagtgacatggaatccatgaaagggagtgtgacagataagcaacttttcaactgtattcgcatttatagagtgttttaggaaggtaaatattgaaaggaacacaacgaagtaaatgaaattagaaatgcacattttattttgtgaaaatacaattttttgtctgtactaggactatatcaaccagaaagatagctctccatgagacatcatgactctctaaaagatgcttattgtacagatgatgtttttctaaatttacagatctttttcacctttagtgtttatgcctggtatacattttatcctatattatcttgcacttttatcattcatgaaacattcagcaagtctttactagctcgttggtgaaagcaaaatgaatacacatttctccccatttggcagacattttctgagggtgtaaatttaataaagttatactgagaacttcttaactacctcctatacacaagatatgcacacactgagagaatggtgcagatgtgttaattagtatacatagaaaagtaaataacaattcatggcaatcattgtatgtaggcaatcagtagggtttctattagattcattagttctttcattcactcttccaattattcatttgaaatatatcttcacatttcattcaaaacctaagattctctgattgtatgatatgatggcttcaaatccactcacttgtctaggtttaccttgaactcttctttatgatgtgtgtgctctctttccaaacagccctaagaaaagaggtcagaggacataatttctctttcttcagaggcgtattctctgaaactcctggaagcatgctatgaaagcaagtaatattctctccatatctacttgctaaaagaattagtgtatatatgcacataaacatacaaacagagatacataaatacatgtattttctaaatgtggtgtcaatatctcatcaatattctgtatctcatcctggattgagttacttatcccaaggagtctcttgctaaactgtagaataaagtatcactcagggcattttgatatatccaaattaatgcagctattttaatgccaccatttttatccaggaggttgtttgtagaattttttttatttggtcccattaaaatatgaactcactgcatttctttgttcttatttatcagggaggccacttaagagaagtcataattatcagcccattcttgatcctatctccaacacaattcccatccctcgagtgaggtaggcaaataaattttcccattgtgccttcatttgtatttatgcttatttcctgtctattcaaaattctccatattttcagtccaaattgcagaagaagctagtttggttggcttatttaattactattaactttactgagtagagtcatttatggctgaacatgttattgttcatcatggaaagtatggcttggttacctttcaataacaaaagcatctgatcctgatctaatcagtggccaactctgcctataggatacttcactacttatttcataagcattggtttgtggataatgcaggttcacaaagaaacagatattgggtatagcttggctgaccaaaggtgctaatttgcctacaacaaccccagtttgcatccgctgtttagctctcccagctgtctaactcacctatccttcctcaagtattaatgtagatacagtgccctttgtgtcattggttgctatctttctatatgcatagtttcaaggatgtgcctatctaaaatgatcaaacctacacacaattattgccttccaataaggatggaattcaaaggcatctctggttactatatccacagagaatatcacaggctcctttaaatgctgtttgtcttggaatccacagtctccatatgttgtatatttttcctctaattccatcataattccacccagatgttaccagatcatctataagctatggactacatagtaaattgagttaccaatacagttagtgaagagaggataattagaacacatgcaaacacttatgaacaatggcagtaataaccaggcacagatgaaatctgaagtcctttttctacttcacaacagtttagcagtttttttgttgttgttgttgttgtttgtctcttattttctctgtggcatattcttatagtctttggctttcacccagaaccccagttggctataactcttagtataatggtgtgagacaaacccctggttgttcagaatccaaggcctttgtggtcttgcctgtgcaatgcagtggtagactgttgttaacttttaccactgaccatggtcatacaagaaccatagcagagattccccaagtcccaaattcacctgctatgaaaattcacacctaagatgtctgcatagcatgatagcacctatgatcacttgtttctctaaaattacggagttttgagattgttaatgtgcagttttagtttccaacttaatgaaatgtaggtcttttctctaggttgaatgatacttcttttgccttttataattgtagaggagaaaaagtaaagattttgaaatttatccattaagaataatcatgagagattaaatccaacacctccaaagcacggtgtcaagattcaagtgttattgcagggaaaaaaagagataatgtttcagattgcagaccacatcttagaagcaagttcatcaggaaaacctcaaaaatcccattttaataaagacatttcacttctagagcagtc

SEQ ID NO: 786 - DNA, 20589 bp, Homo sapiens
acactctcccctcttcaaaagaggagggactggaaaggaaggagtccaatccttaagagagatgggagaaggacagagagtctcggtctccgaggataagtccagtcaaaagctcgcacgggctgtcctagcaggggctacggcggccgacaagtcccatgagcagcacctccgcttctgcacgcgcttcccaggccggaatgctcggcgctctcgcgaggaggggtaccgactggggcgggagtacttcggcgagacttcctcctctttcggcccgacttcctcctctttcggccccgcctcttggcgcggggtcgcaattgggcgggaggttctcgcgatctccccgtccacgcctgcgccgcgagaggccgctaggtggaaggggacttcggttccgcacgtcgtcatgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctgccgaatggaaacccgctaaaccccgttatggagtctgctacaattaagcatctaaccaggaattgtctatggacacaactctccaggcaattcatgcagaaagtgtgttgacgatttcctgtttcttgcagagcgcttcaccgttaaggctcttagtagctggcgattgtaaagcacattttccgcttcatgaaaatacagtgctcttcttgtgtttgtaaccttggaaagtaagtctgctatgataagtttagggaagtggcggggagctactttcctaacatatctgtgattgttttgatacttctcagtttctcgcgggcatttcctgcgttctctatagggctctcttgcactgaataaggaaaggaggaattctctctgcattgaggctattatcgcacattgtgcggtggatatagtcacgcgctgggtcgtagtagcgtgtcgtttatttcagtccagctcactcttggtagaatccctttattcgttttgttgtttttgatagtctctctctgcttcccaggctagagtgcaatggcgctatctcgactcactgtagcctccgccttgagggctcaagcgatcctctcacctcagcctcccgagtagctgggaccgtagacgcctgctccccatccccgctatattcgttctttaatacagtctctcagcttgttcagctgccacttctgtgcagctcattagcctgatcggtgaaaactaggcgagacgcgcacactgaccctgcagtgcatcttgggagttgtagtcataactaatcaatggtcttgttaaaacgtgcttatgttttgaccagatcgcttaagtgtggacacccttcagcagtacactacaacgtgggtcagtgtacagaacacatgctgatagaaataatttcaaaatctggattcatagtttttttttttaatctagagacctcagaaaatgtacttgaagaaaatcatcataatataatacataacaatagagccaattaattgatgtgatgaaagtggacaaaatgtattttgacctcagagaaaataacatttctgtcttggaagagtcagagaatgcttcacacaatttttgagcctgatgttagactctccagccttctgtccaagcctcaccctttggttactccccaggaagactgaacttgggaagaggattgtgcagaccctggagtcaggcttggcgtttgggatagggaatactagagtgcccacagcatggtctggaaaagggaaagtgggctgcaggtggctacagtcccatgattccatggatttcagacccctccaaagcacagggctcagtgcttatccaagtctgagggccccccataaccacatcttccccagcagatgttctttgcttcaggcagtcatcaaagttccacttcaaagagttgctaaccaaataagcccacaatcttccttttttgttgttttgaataagtaatgcctttacacatatgaaattaaaaagagaggccgggcatggtggctcacgcctgtaatcccagcactttgggagggcgaggtgggcagattgcccgaggtcaggagatccagaccagccaggccaacgtggtgaaaccctgtctctgctaaaaatacaaaaatcagctgggcgtggtggtgggggcctgtaatcccagctacttgggaggccgaggtaggagaatcgcttcaacctgggaggcagaggttgcagtgagccaagattgcaccactgcactccagcctgggggacagtgtgacagactgtctcaaaaaaaaaaaaaaaaaaaaaggcaaagatatatagtgaaaactaagtcttcttttagtctttgtctcctgccactcatagaattttcctcttggaatcacctctattccattttcctgtgtatgttgccagagcagggctggcttcatggtggtgacctgtacagataggcacttggtttaatgttttgctgtcactaacttgaaattcaggaaagtttctggacaagggccctgcggttttattttgcactgggcccacaaagtatgtatctagtcctattccagagatattctatgcatatacaggtaattatatgtagatatgtatgtagtggtccagtagtggtccagggcctgttaggaactgggcggcacagcagaaggtgagtggcaggggagccagcatttcggcctgagctctgccccctgtcagatgagcaggggcattacattctggtaggagtgagaaccctattgtaaactgcacatgcaagggatctaacctgtgcactccttatgagaatccaactccccctttccatggaaaaattgtcttccacaaaaccagtccctggtgtcaaaaaggttggggacctctgtagtaggctaccatctaggtttgtttaggtacactctatgatgttcacacaacaaaaaatcacctgatgatgcatttttcagaaagcatccccattgttaagggacacatgactgtaatggaatactattcttttccttcctttttattttttgtggagacagggtctctacatgttggtgcccaggctggtctcacactcctgagcttaagggatctgcctgctttgacctcccaaagtgctgggattacaagtgtgagccaccatatctgaacccctgtcccccactttttttttctttctttttttccatacacagtccaggctggagtgcagaggtgtcatctcggctcactgcaacctccgtctcccggattctaacgattctcctgcctcatcctcctgagtagctgggattataggtgtccgccaccacgcccagctaatttttgtatttttagtagagatggggtttcaccatgttggtgaggctggtctcaaactcttgacctcatgtgatccacctgcctcagcctcccaaaatactgggattacaggggtgagccaccgtgcccaggacagccttttttgggtcagtgtgtatatagagctaactcattctacttaatggctacatagtatcccactgtgatagccgcaaaaggcagacaaatcctaggcagacaggggcaggtccctggtgaaacccttcaagctgaggacagtttaaaggctagccacaagaccaggataaatccacagaccagattgagaacctctcttcccatttggcgtgctttcttctgattgatccccacccttcacctattttacacatatcctttcctaattgtttttttacactgttgtacctacctttgagtggtgctgttgttttagccttttttgcatactcacaaaccaatcagcatgcacgccttcattctgagcccataaaagctgtggactcagccgcactgagagagagaccacctgactttgagtgagggaccacccttgcatcctctctctcctgagagctgtttcatagttcaaataaaactcttctccaccctcctcaccctttgattgtcagcgtaacctcattcttggacgctgaagaaaaattcgggacccaccaaacgcagatacaaagaaggctgtacacactgtggccctttgccctctgctggtggagggcaaccgtcccacacaacgcgatgggaagcagcagtggggcagagccagtcctgaagccacgggcctgagtggggcaatgggactgatagagctgttaacatgccactgtccgttggcctgcagacggcagaactaaaagagtgcttagcatactgtaacacctctggggcttcagggtcatgagcacccctgtttgggtgccaccacatttccctcaatgtgacacacctggtccagccacaagccccgcacagagcccactcctgccctgtactcgttcactcacacaccccctcctgccaggggctgaggccatggtggctgcaggattcgtgcctgagcacaagccagacacatcctggtgggccgagtagttggggtgttgctggccggaggtctccagctgtcaaagtggccaagaaaaatcctgcatcaactgtacaaatgtaccctaatttatttaactcatttattgtatatttgtgtcatttccaatggttcgtaatttcaaacatatgattgtgcaaaagttgttttatgtgtgccaatatctttgtaggttaatttcctagagcaaagtttttcaacctaagcaccactgacatctggggctggataatttgttgtgaggggctgtcatgtgcgttatacgatgtatcctatccacccctatatgttatgaaaaatatttcagtggccagaatcctttcaatgacttaaaaagcccttttcatcctgcttctgcctacctctccagctgcatcttagtacccgcacactcttttttcatactcatgcccctgcttgctgtctttgcacaggtattctctttgtctggagctttcttcctcaccaatcatctcctaataactcccattttatcttttaaatgttgccactattatcacttccttggaggagccttcttggactgcctatttcaaatcccctgggttttttttttttctttgacaaaagccacattcgaacaaatcccccttggaatgttacaattaccaaaaaatccaatttaaactagtttaaatgataagagaatttattggctcacataaatgagaagtctgaagataaggtgaacctcaggttgatttgagtgacttaacagtatcagcaggaacttgatttccttctacctctcaattttctttctgatgtcagattcatcctaaggcttactccttttgtatcataaaatggtggccaggatctcccaaggttatgtagttctttgtccatatcaaaagagagtttctttcacatatttcacagtttcaatgtgattaaattaatttaggtcacatgtccgcccctaaacctagagttttgtggtctagagaatgtcaagcactgattggccagggcaaatcaaggcctatccttggaactggaagttacgttaatcccacctaaatcccatgaatgttactctatgaggtatcggtaaaatcgatgctaggaatacaatcagaatccattatatcctattacacgcttatagcaccatgcacccctccattgtagcacctgtcatacttgtagctttatatttatttgtatgatttctgattaataactgtcttctcatccagatgaaaaacctctattagtccagggaactgcattttttctcaccattgtatctctagtctagcacagggtgtcaaacatagcaggttctcaataactattgaaagaatgaaacttcccttagaagtttactactcaatttgacattccctttagcaggcaatttaatagctaccatatcagacttatattacatatttgaaagtcccagactgagatctctaatttctatctccaggcagtcagttcttgacacaccactgagtaagattcatggaataaatctgaccatattatattcccttgacatctttcaagttcctgatttcttttaggataaagttctttatgatgccattcaaagctcttcatggtttggcccctatctggctttctattctcaagagcaaaactatagacttctggccttcttcagggtgatctttctctttcaatcatagtccctccccaaccactcaccaaatatcagtttttagaagtcttgtctcttgcagggagtagagagggggcagtaatagtttattcagggattcccccatatctttcctgggtaaaggtattctagaaggaggcagaggaaggaggctagaggtcccactgtttggcattcaggctttcacttaatgctcactttagccctgcttcacagtcccctactacctactgtgactaatattctcaagtcaagagtctctcccattctagaaaataaatcaggctcctgggatgtggtgatggtgttataggggcatgtgtgggtatgagtgtgtgtgtatgtgtgtatgtgtgtggggtggcagtcctttggttatatgggattggggaatagacccaggaatgtaggtgttctttatataggctttcacccttccctaaaattttctgccctgatcctttctaatttttttgtggaaagaattagctcttttaatttatttattttattttattttatttcattttattttatttttttgagatggaatcttgctctgttgcccaggctggagtgcagtggtgtgatcttggctcactgtaacctctgcctcccaggttcaagcgattctcctgtctcagcctactgactagctgggactacaggcatgtaccaccatgccaggttaattttttgtatttttagtagagacgggctttcaccatgttagccaggatggtctccatctcctgacctcgtgatctgcctgcctcagcctcccaaagtgctgggattacagacgtgagcgactgcgcccggcatctttttatatttttaaaaggtcacatgtatgtcctttcctgtgaactgtttatattctttgccaaagtgctgggattacagacatgagccactgcacctggccttacctcttctttttttctttaatcacctgtggaggcttttagattgtgccttttgctgtcaagtctactactactcttccatcggcttgtcatacaaccatttgttgaaatttcttttgtattttgtttgccttttgggctctacactttttaaaaatttatttagctgtcaaagagatgacatactgtgtatggttaattttccatgtattctggagttctaatatattttcatggtttttaaatgtttagttctttaatcaagttggaatttttaaaatatatatgaagtaggatgctaatttaaaacttttcctccaaatggatatccatccagttgtctcaacatcatgtatagaaaaaacaaattgaaaatgctatcttatcatattatttactaaatttacatgcatatacatatacatacataacatatatctgagtttgagtctgaattcactactgtttcaattgctgtagttggtcaattctagtatgacagagttttaattgctacagttttggaatgattatggggttacttttgagacagggtctggctatcttgcccagactggtctcaaacttaccggctcaagcaatcctcccatctcagcctcttaaagtgttgggattataggtatgaaccactgcacctggccctggattgcattttgactgtggccatagaagtttccactcagatcttcaagagaacctactctggggactacaagtgactgacagccagctgccacccctttggaactaccatgcattcatgtcaatgccacatatctctggagtcgcccccagctagtggctgagcacagcaggagtactaaacttgttctttcttgcccagtgcagaactcctctaacgggcaactttggcttggggaacttctcatcagcctggatgagactatcttagaactacagtgtagtcgaggctctttctacccaatatttccttctcttctttttacagaagtcagacctgcaccacagtctgaagtctctctgccaattcctgagccttcccactttatccttcacaaacatttcccccaataaatatcttgcatgtctaatcccttcttggcatctgcttctctgaggaccagaacagacaggtggtttaccaagtggtgcaagaaaacagatagtaagatgggttttgggcaatggcttacttggtccctggcacaaagcagccatctgagtcctgatttagccagcagtgacctaggaaaacatcccagagaagggaaatcctcttgctcgtgcaatttaggcatttaaaagatatggggaatacgatgcctacaaagaaagcagagctggccaactgttactaagacaagtaatgccttgcagatggataatgagaaaccgagagcacttaaacagttaaaggctaagtgtgggagccgggggcttctctggagcttaacaaacttttatttcctgcagtggaagagcagaaatgggattggatggtcacagagctctaaagatatttgaatgctcagcctagggagatccagtatgtagtcagggcgctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggagttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggtgatggctttgaaaaagtggaaatgaattcacaccatggcagcttttaacttgaggagaagatagctatttattttggcatatttatgtggttactgctcacttactagtcccaattgttttgtaaccactttttatttattttttgagatagtctcattctgttttctagactggagtacagtggtgcaatcttggctcattgcaacctctacctcttgggcttaagccatcctcccacctcagcctcctaatttttgcattttttgcagagatggggtttccccatgtcacccaggctggtcttgaactcctggactcaagtcatctgcccattttggcctcccaaagtgctgggattacaggcgtgagccaccacatcgggactgttttttttgttttttgagatggagtcttgctcttgttgccaaggctggagtacaatagcaccatctcagcttactccaacctccacctcccgggaggatcccttgagcctaggagttcaaggttgcagtaagctatgattatgtcactgcactccagcctgagtgacagtaagaccctgtctaaaaaataaatagtggtttttagatgatcatctgcaaatatttttgttctttccctgtatccctttttaatctcatcacattgattaggacatccagaacactggtgattcttgttttgttcctgactttaatggccatgtttccagtgttgtatacatgttcctaatttttgatacataccacttgtgacgttaaggacatttcctgatattctaaactctctaggaaatggatattgaattattaaaaaaaaaagtctctttttagcctgggcaacatagtgagacccagtctctaaaagaacaacaacagcaaaaaatttgctggcatgctggtgcatgctggcagtcccagcacctcagcaggctgaggcaggaggatcacttcagcccaggagtttgaggctacagtgaactatgatcctgccactgcactccagcctgggcaacagagcaagaccctgtctccaaaaaaaaaaaaaaaaaaaaaagaaaaacaggaccattttttgcatctggtgaccatatggttttctcttaatattatgacaatttataactgttctcataaatgataatgatctataaatttttatgtttgcttttttttaatcatctcttctaggttatgagtcctaggcaattgcattaaattttataaccatagtattaaaaaaactatttatagtcaacaactcaagtttggttttcatgaaacactgggtatttttcaatgcttcccatcccatgcaggataaagtcagagtactaaatctcatattctaaactcccacacaatctgacgtctatttactggcttcttcatccattaataaaactgttccttctccacaaagtgcctttccctttataatcgtcctttaaagcccagctcaaatactaactctctatattgaaatccagttcaaattccacttcttagaaaccttcatttttccttctagtttacctcttctctttttatagcatgactttttaaaaactttcattatagtgctcaccaacctgcctttcattaattagtaactctgtattagactatatttaagtccctgaaggaaacaaactattccatagcagagtactgtgctcctaataggtagttttaaagtttttattacattaaaattaattttgtaaatttctgttatattgaagcctcttgcaatgatctgagatatgctttagatggcaaaactgaggttgctttaaatattacctttacaaaagtcacttattaccaaattgccttttagaccattttacctgtctgttggttgatgacttcatactcatatttaatgagtcagacatctctctcttttttgagacacagtctggctctgttgcccaggctggagtacagtgggacaatcatagctcactgcagccttgaattaccgggcccaagtgatcctcctacctgagccctcagcctcccaagtagctgagattacaggtgcgcaccaccatgccaggctaatttttttattttctgtagaacaaggtgtgaccatttggcccaagctggtactgaactcctgggctcatgtgatccacccactttggaggctgaggcgggcagatcacaaggtcaacagattgagaccatcctggccaacatggtgaaaccccgtctctactaaaaatacaaaaattagctgggaatggtggcgtgcagctgtaatcccagctactcgggaggctgaggcaggagaatcgcttgaacctgggaggcggaggttgcagtgagccgagatcacaccactgcactccagcctggcaacagagcgagactccatctcaaaaacaaaaacaaccctattttgtcccttttagtttctatttatgtaacagatcctattgtcctcacaatcctcagcctgaaatccttagtcataactgccgctctcttccctccacttgccactcactccccattttatctgggttaagtccatccattatcccttatatttgctctgcaacatcttggtatgtgcccagcccactttttctgaatacactctcttctcagaagtgagctcttggtaattttctgaccagttgcttataccaggtttagggttaccagatttagcaaataaaaatatagacaattgtctgaccagttgcttatatctggcttatgggtaccagacttagcaaataaaaatataggacattcagttaaattatttgaacttcagataaacaaggaataatcttttagtgttacatgggacctacactgaacatctgtttatctgtaattccaatttaatttggcatcattattttatctggcaatctcagtcaggtttaacacctttcccaagctgagcttgtcatttcctccaaaagaacacaaacctataaaggacaggtaacgtcctgtgggacagccatcctttgccctatgctgagaaaacaggtttgcagagaataaaaacgaacaaataaataaacatttaaaaaagcagttgtgtggaaagaagcacaaaagagaggccatgagactccataattaagcagagatgaactgccctagttcttaatggcttgttagtcctcattccagtcttccacagggtgtgacttggcttccataaaataaactcacggtcccatgatcattttccctctttgctttagcaagaatctttaactaaaacaactctcttttcatttccactgtctaccactctagtctcaactctcatgagtctggaattttgcaaaagcctgataaacttgtcacatgattccagtgtctacccattccttgtaagtaaccaagatattcttgcctgattaaatgctttgaaaatatcatcttaggccaggcgcagtggctcacacctgtaagcccaacactttgggaggctgaggtgggcggatcacttgatgtcatgagttcgagaccagcctggccaatatggtgtaaccccgtctctactaaaaatacaaaacttagctgggtgtagtggcgggcgcctgtagtcccagctactcgggaggctgaggcaggagaatagcttggacccgggaggtggaggttgcagggaggtggaggttgcagtgagctgagatcacgccactgtgctacagcctgggcgacacagtgagactccgtctcaaaaaaagaaaaaaaaaaaaatatcatattgtattggccatcccttgtttcatattcgttaataaactttgctactttgctttctaatttcggtgaagaacaagcacaagattaaggagtaagactatgtgaaactgggttataaattgaaaggctgttggctgttgtatcttgtaaacaattcaacgcaatgccaagtgaaaatgaagttgttagtccctctatctagaattctttcccaaatagctgcatatctttttcctctgcttcatttaagtctgtgctgaaatgttatctactcagagaagacattctggatcatttcatattaaatagtaacttttatcactctatctctttatctagttgtttttctttaaggtacctaccactacctgacatgttgtacagttaagttcttacttaatgtcttcgataggttcttgcaaactgtaactctaagataaactacataaaatgaaaccaaatttaccacaggctaattgatataaacaagagttaagatcctatggcacatttctggtaaaaaaaaaaaattaccaaacttgcaaataaagaccaaaacatttctgatgttaaacactgaagtaaatgtgagctagacaacattcaagaaagatgaataaaacaagatgatttatcaaattacaacagttcagggttttgggtggttggagcccatcctggcagttcagggtgccaggtgggaagtgatactagacaggacagccatcacattgcagggtgcactcacacacacatccacactcactcagactgggcaacaagagcaaaactctgcctcaaaacaaacaacaaacaaaataaaataaattatccagactcaggtatttcttctttcttttttgagatggagtctccctgtgtcacccaggctggagtgcagtggcatgatctcggctcactgcaacctctgcctcccaggttcaagcgattctcctgcctcagcctcctgagtagctgggattacaggcgtgcaccactatggccggctaacgtttgtatttttttttcagtagagacggggtttcaccatgttggccaggctggtctcgaactcctgacctcaggtgatccacctgcctcagcctcccaaagtgttgggattacaagcatgagccaccgcatccaacctcaggtatttctttatagcaatgcaagaatggactaatatactcctgcagacgtgggaaaaagtgcagactccacacagacggtaagcctggccaggaatcaatgttttgtttccttctcaacaacattttaatgcaaatgatgttgaaaaaaaagttattcaaggacctgctgtatcgtaatttgctatcaatttccaaactctagaatatgagcattggaactttagctgttttgtctgtttttgttattttgagatggagtcttgctctgttgcccaggctggagtacagtggcacgatctcggctcactgtaacctctgcctcccgggttcaagtgattctcctgcctcagcctcccgagtagctagaactacaggcatgtgccaccacgcttggctaatttttgtatttctagtagagacggggtttctccatgttggccaggctgttctcaaactcctggcctcaggtgatccacccgcctcagcctccctaagtgctgggattacaagtgtgagccaccgtgcccggcctaacttaggtcttttatttactgacacatcccctgcataccttataatgcctggcacatgttaaatgatgaataaaagaatgctatgcttggctgaactgaactaagaaagatattcatgttttcattttagatccaagaatgtaagatattctgtaatagaagaaaaaatgattatataaaaactgtactgtgatagaacagtaacttatggagtatgtgtgttcctgtatcaaaacaaaagtcatgggaaaaaaagtcttacttttaagtacttgtattgagctaaccaccaaagatggcattcagtttgatctgagtcactataaattagtgtttccagcatataatatagccgtcatagaaaaacttcattggggccaggcgcagcggctcatgcttgtaatcccagcactttgggaggccgaggtgggcagatcacaaggtcaggagatgagaccatcctggctaacatggtgaatccccgtctctactaaaaaatacaaaaaaaaaattagccgggcatattggcaggtgcctgtagtcccagctactggggaggctgagtcaggagaatggtgtgaacccgggaggcggagcttgcagtgagctgagaatgcaccactgcaccccagcctgggcgacagagcaagatgccatctcaaaaaaataagaaaaaataaaataaaaatacaaaaattagccgggtgtagggcacctgtaatcccagctactagggaggctgaggaaggagagttgcttgaacctgggaagtggaggttgcagtgagccaacattgcgccgccgcactccagcctggcaacagagtgagattctgtctcaaaaaaaaaaaaaaaaaaaagaaaagaaagaaagaaagaaagaaaaagaaaaacttcattggaaagtagggaaaactaccaacatttaaatgaagacaaaaataagaaaagttcagacataaagtgtaggctcttggtttaagcagaaatggtgttcttttggtggtttgcagttagtaagctgtatttgtactttgtgtcagttcaggtttctggagtttgtttaagaactggcttcattttccatattattaggagttgggagttcctttgaaaaagaaaacagaaaatttaagaaaaacacaaattgcaattttgaaattctaccattaaggatgatatcttaaaataagaattatgtcttagaaagcagaagtgagaataaaaacttttgttactgttattaaataatagtcgatatcaagtgtagaaagcaaataaatttaatctttcattttcaattaatctttaatatttcagaagtatatcaacattgcctaacatgctattttacacacaatagatatataatcaatgtttattgacttaaaaatctttggtttagccagataaatttgtaatattttatgaactagttaaccctgagtcatgaatttaccttttttttttttttttctggagacggagtcttgctctgtcgcccaggctggagtgcaatggcgcaatctcggctcactgcaacctccatttcccaggctcaagtgattctcctgcctcagcctcccgagtagctaggattacaggtgcctgccaccatgcccagctaatttttgtatttttagtagagatggggttttaccgtgttggccaggctggtcttgaattcctgacctcatgtaatccacccgcctcggcctcccaaagtgctggaattacaggcatgagcttctgtgcccaccatttttttttttgagatggagttttactctttttgcccaggctggagtgcagtggtgcgatctcagctcactgccacctctgcctcccaggttcaagagattctcctgcctcagcctcctgagtagctgggattacaggcgcccgccaccacacccagctaatttttgtatttttagtagagatggggtttcaccatgttggccaggctggtctcgaactcctgacctcaggtgatctacccgccttgacctcccaaagtgttgggattacaggtgtgagccaccatgcctggccagatatacctacatttttataagatttaaaattttttttagagataagagtcctgctatgttgcccaggctggagtacagtagctattcacaggtatgattgttgcacactacagtgtcgaacttctgggctctagtgaccttcccacttcagccttccaagtagctgggactacaggcacgtaccactgagtccagtgtatttttataagattttaaaaaagattacacattctaaattatgacgtccacataccatttacttttctgtggaattataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgataagtaaacaattttttttttttttttgagacggagttttgctcttgttgcctgagctggagtgcaatggcgcaatctcggctcactacaacctccacctcctgggttgaagtgattcttctgcctcagcctcctgagtagctaggattacaggcatgcgccaccacgcccggctaatttttgcacttttagtagagacggggtttcaccgtgttagccaggatggtctcgatctcctgatctcatgatccgcctgccttagccaataatctttctgtttaggtaaatttgaaaaatatacatcattactaccacattcatcctagttagaatctcatttatatttattccactctgtttatgatttggtaactaatttgaaaggcattatattatcaaaagtgtatcagattagctccctcaactcactatatctgttaacagttctgaagaaataggcactggctttgaatatggcctgttccagtttgtgaaccgttgtaggcaagtaaagttgttgggcacagaggtgacctgtaggatgactgaaggtaaactgtcactactgtatacaaagaagaaaaataagatgtaggaagagatctgttataataacatatgacatattctatctaagtttttcatatatttcagaattgtaaaaacaaaactatgtaattttttctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgtgttaaagaaacagatcttcctttaaagttacagcacattgagtgacatctaaactaatagacatttaaatttacatggtccaaataaggcaatgattgtttttacttgttcactgaaagcattgttcagtgctaagtggacgtatacacttaacacatataagtagtcattataaaagagaaaagagacggggcagttagttgttcaactataatctgccgctgaactcatctgtgcctttttattctcaccaggccaagtccttatactgggggaacagtcacaggcatagtgaatgatcctagacaagggctttgagagcctaattgtgttatatactatagaggattatgcttaggtcacttggattttcactactgctcaaaggaccaacacattagtgtttatttggcttcaccttggaaaatgaaagtcaggggcaaatgcaaaggtttaaagttccttctgatgtgaaaacaacaacaacaacaacaacaacaaataaaccaaaaaatcaaccttatacagagatactatatcttagcactcatcttcccctggaggctacttggacaataagactacacattgggaataaaccagaagccttagttactcaggtcatgcgtattagcgtaagtgaaagacaatgtggtggagcccgaaaaaacagactggcaatgacttctttcatccactcataaaggactacaaagaaagggccaattttgttatatgaattctaggcctgaataacatggctcttaccaagctcaaaaactttaagtagtggagaaacaaagtctcacctcctcaaagatgacattcaaagactttaacaagttaccttatcacagttcttacgtcagtgcccaaatcatggagtctgcatagctaacactaacatgctcatgtattttttaaacgaactaagggtgactaccattttggccaagctgcaagctccttgagggaaagaattgtgtcttaaatccttaatgagtctgttcaagcaattctaagattaaaaatgaagtactgcatacaaataaaaaacttcatagatggtgactcttctttcaactttttgaaaaaaacaatggaagcttcaagaacaatttacaacttcaaggctaaaaggtggaatacaaatacctgaatttcttggccaacttctaatcctagggcagtaggatgtttaatctggaaaaaaaaatgttaatctattagttgttgtgcataattatgtagtgtccatggaagtacacattttttcctcaagctttattagtttttctgattaaaaaaatcagttagcggctgggcgcagtggctcaagcctgtaattccagcactttgggaggcagaagcgggcagatcaagaggtcaggagattgagaccatctctggaggtcaggagagtgaaaccccatctctgctaaaaatgcaaaaaattagccgggcatggtggcgggcgcctgtagtcccagctactcaggaggctgaggcaggagaatggcgtgaacccaggaggtggagcttgcagtgagccgagaccacgccattgcactccagcctgggtgacagagagagaatccgtctcaaaaaaaaaaaaaaaaaatcagctgggcatggtggctcacggctgtaatcccagaactttgggaggctggggcaggcagatcacttgagctccggagttcgaaaccagtctgaccaacatggtgaaaccctatctctactaaaaatacaaaaactagctgggtgtcgtggcacacgcctgtagtcccagctacttgggaggctgaggcaggagaattgcctgaatctgggaggcagaggttgcagtaagctgagattatgccactgcattccagcctgggcgacagagtcagactctgtctcagaaaaaaaaaaaaaaatcagttaattataaagatttaaaatacagatgtattaagaacataaaaattatccaaaacaggctgggtacagtggctcacacctgtagtcccagaactttgggaggccgaggtggaaggactgcttaaaccagactgggcaacgtgaagaaaccccatctctacaaaaaatccaaaaaaattagccgggtgtagcggtttgtgcctggggacccagcttctccagaggctaaggtgggagaatcacttgagcctgggaggctgaggctgcagtgagctgtgatcatgccactatactccagcctgggtgacagagcaagaccctgtctcaaaaccctctcaagttgtagataactactgctaacattccaatgagtatcccttcagat

SEQ ID NO: 787 - DNA, 1294 bp, Homo sapiens
ctctgaggaccatccacctccttcctgcgccctccccacagctacggcggggcagagagaggtgatgcgtgccagggtcgggagtcacagaggcttttgtacttttttttgtagagatggggtttcgccatgttgcccaggctggtcttgaactcctgggctcaagcaatctgcccgtctcggcctcccaaagtcctaggattacaggtgtgagccaccacacccagccttagatggtgagtgtttattgaacacccatagtgtgcctaaggctgataggcatggaggaaacagaactgaagaagagatgtggctcctggctccatgaagaactgggtgagatgacatgcatgcaaggacttagcacacagcagatgctcagtgggtgtaattttctctctcttcctatttgtgagtcgacatgaaaactgcttctctgggtttctgcctccccccatgccctgcattagagcaggacagaatgtgtgccaccgtgcctgccattttaaaaaattttttgtagagatgggggtctcactgttttgcccaagctggtcttgaactcctggcctcaggcaattttcccatctcagcctcccaaagtgctgggattacaggcatgagccaccgagcctggaccagaatcttacttctttcttgcaccatggtccttcgaggatcctgtcatgagtgaccttccatgtggtgattcagcggcccaggcgccttccatctcatggctctgccatcttctctggccttggggagtttcatctctagctggtggttggggaggaaagagagctgaggactgcatgggaactgttcatgggctgagcctagaagtaatgtacatcacttccacttccaattctattcatattctactggctgaaactctgaaggagaggctgggaaatgtagtccagctacacgttgagggagagagtgaacaggctttggtgaccacacagccatctctgctcagatacccaaggaggcaaatagaagagccagtccatgccttcaacatgcttgctccacgacctccctgagcacctgtggcctctgagtttatggtcagggtcaacagtgggggaatctcatgccaccaaattccaggctggcaagagcctggaaaaccttttggctggagagcccgggtcacctgctgacttatgaaagcagtgaaatcagtggttctcaacctggggtgacattgtctccctagaggacatttgacaatgtctggaggcatttttattgtcacagctcagggatgctactggcatct

SEQ ID NO: 788 - DNA, 3223 bp, Homo sapiens
cctagaacagtgcctggcacataatgtggatgtcagtcaatgttggatttacttgtgcttgtttatttaaaaactatttggggttagattgtcaggaaccctgctacatgttgtgtaaggcttctagtgtgtacgtgtgtgtatttcatataatacatttatgtgtatgagcagttggaattgatcactaaaatatttcttaaaggtaatataagtacaatttggtatgttgagtatcatgaatgaatcaatgcaaagattcaagtatctttgggtagaatcatgtcctttgaaatgtcagtgtacagtaaaaaggtctgacatcataactagattataaatcctatactcttgtactccaaagtcagtatagttggactggcttgtatgtcctgtttgacaaaatataaattttactttcctgtggcaattcccaaactgggctgaccacttggacttttaagaaaatgtaagcactcttgggcattgacccaacgattttcattcactagatcctggggtggggcctaggaatctgtgttttttaataatttcctttctgtaggtgtttacatatagtcagtttctctgctacccacctttcatgatatactttgaaatttggtgacaatcaccttggaccttttgggttctctggaaatggtaaccagtaaggtaattaataattaatatcttatactggtagagggaaagaaatgctaacatgtgtcatactaaagatcttttaggactagtgctgactttctgttcatatatttcactggaaagctattgtcaggacattttgcggaaggtgttttttaaaatgtggcatattcatagagttgtattgctggaagttaccttagaaatcatttagcttattcccttttatatttgagttaatcttaaaaatgttagggttagggtgtaccacttattagttaagttgcctcatttctcttagccatggtttcttaagcataagatgggaatgataatacctacctaccttatagttttttttaaggatttaactgaaattcaaaaaaagttgctagcatacatcttgtttgtagcagtgtagcaagtgttcagtaaatgtttaatattttgacatacctataatatgatctatggtatacataaaagccaaaagaggtagaaaaagttatagtaattaagttcaagttaaaaatgttgtacacccacaggcagagttttatttttaaattatggtataatacttacacaatacaccattttaaaccattttaaccatttttaagtaaatcattcagtggtgtttagtacagtcagtgttatgcagtcatcactgtctagtttgagaacattcttattaccccaaaaggaaacctgtacccattgaggagccacttcctattcttttctctgtatccgcttgcagccactaatctattttttgtctttatggatttgtttattcagtctctttcatatgagtgaaataataaaaaatgacttttcactgtataatgttttcagggcttatccgtgttgttgtgtgtatcttactgcataacttccattttttttaaatgaccgaataacattccattgtatggatataacagccttgtttatccagtaatcagttgatagacatttaggtcccttccaccttttggctgtgtgagtggagctgccacgaacatgcatgtataagtttttgtttgaacacctattttcactttttgggtatacacgtgggtgtggaattgctaggtcttgtggtaattctatgtttaacttactgaggaagtccaaactgttttccacagtggctgcaccattttacactccattagcaatgtatgagggttccagtttctccacatactggccaacacttactttctgttttttttttttttaattaaattttatagccaccctagtgtatcttattgtggttttgatttgcattttgctgatggctaatgacaggcatctttacctgtgatttttgaccattcgtatatcttctttgaagaaatggctgttcaagtgctttgcccactgtttaattgggttgtctttttgttgttgaaagcagtcttttgattatgaaattaatttatgtattcttctctagggagcttatttggaaatatatacttggtaatataaaaatttatttcggaatataaaataaaggactggacttcattactttttaagtaaacttttattggatgcttccttttaatgtatttttttttgtagaaatgaaattgttttaattttatagcttagcctgatgcctgattccatgcttgcactgactctctgtctgcactaacaaattatcagatttattcctttccaaaatatcattgattttttttcagatcatagaatattcctctcccaacttttttgttgacagctttactgaggtgtaatttacatgccataaaatacacccattctaactgtacgtagttcagtgatttttagtcaacttaacagcattgtaccacagttaacacaatgcaatattatagcatttctatcattctgaaaagttttcctcagaccttttggaagtcattttctgttcgcgccccttggtgaacactgatgctttctgttactcttgatttgccttttctgagtatttcacataaatggaatcataatgtatagtcttttgtgactagcttctctcactgaacgtgtttttgtggttcatctgtgttgtcgcatgtatctgtagttctattttttattactgagtagtatttcattctgtggataataccacattgtgtttattcattcactagttgatggggatttggatcatttctagtttttgactattatgcataatgaacattcaagtacaagtctttgtgaggacatcctctttcaactttttattttgaaaaatttaaaccccacagaaagattgaagtaagtagtatagcaaacacctatttactcttcacctagattgactattaacatttgcctgctgttctttgcctttttctataaatataccttttccagaaccatttgtagatattatactttatctcttatgtatttcagcatgaatttcctaagaatgagaacattcacatacataaccacgattttatcacacttaagaaaattagcagtaatctcatgtcagctactttatagtccatattgaaacttgtcccaaaaa

SEQ ID NO: 789 - DNA, 1392 bp, Homo sapiens
gccatctcggcttactgcaacctccgcctcccaggttgaagtgattctcctgcctcagcctcctgaatagctgggattacaggcgcccaccaccgtgcccgctaatgtttgtatttttttagtagaaagacagggtttcaccatgttggccaagctggtctcgaactcctgacctcaggtgatccatccaccttggcctcccaaagttctgggattacaggtgtgagccaccacgcccagcctgagccaccacacccggcctgagttcgccttattgtctagaacccaggtgaggatggagtgaaggtggtgggtgtggaagagcatgttagctttgcttctaggaaagtaagtggagctatcagcctgagctctgtgagcatgcataaaaggagtaacaagtcacttctctcaatctttttttttttttgagacggagtctcgctctgtcgcctaggctggagtgcagtggctccatcttggctcactgcaacctccgcctcctgggttcaagtgattcttctgcctcagcctcctgagtagctgagactacaggtgcgcaccaccatgcctggctaatttttgtatttttagtagagacgaggtttccccttgttgaacaggctcgtcttgaactcctgtcctcaggtgatccacgtgctagggcctcccgaagtgctgggattacaggtgtgagccaccatgcccagctcacttctctcaacctttgaggcatctcttgagttgctcaccaagaagagagggagaaaagagagcaaacagtgtacagtaagtcaagaagacgatgagtgtaatgtaacaaggtagggaagaccaagaaccttttggagcaagatggctacattaggatttctggtcagtcaggtcacataaataaggcagataggaacgttgacactgggaagacaccgttcccagaagccaaatagacaagactatctggccagtcagatacacggttaaactaacagacttttaaggaaaatgaatatgttatttgtacttacagtcaaccagccaaactattatcgatattattatatggcaacaacatagcatctttctagaaatattaatgaacaaattaggaattgtcataaaacagcaaaaggggcagaggaaatcaatgaagcacactagagtttaactctttcccttaaacaattgagtttttaaataagtaaatcctgtgactcccagactgaggcaggaggattgcttgagtccaagagttggaaactagcctgtgcaacatagtgggaccctatctctacaaaaaataaaaaattagccgagtgtggaggcacgtgccagtaatctcaactattccagaggctgaggcgggaggattgcttgagccggggaagtcaa

SEQ ID NO: 790 - DNA, 4067 bp, Homo sapiens
acgcccagcctaatgtttttcttgactcagtaagattaacaacatctgcttgggtatggaatgtgtcttcaggactcacgcctctcaggagtcacagtcctgtgcagcctgctattcagtatcagaaaatactttccaaatatcccagttttctagctgcttagggcaggaaggtaaatctggtccctcacagtcagtcatggccataagtggaaatcgagtctcttcatgcccaagagcacatcagagaaatggagagtgctcctgaatccgaaagggtcacacagacaagagtgaagaatgtctcaataaataccagtgtggaagaatgatcttgaggaccacatccttcactctctctccttcccccctccctttctgcacatcttgcatctcagaagccccctcccggaaactagatacaactccaggggaaggtgaggttgaaatccacaagttcactgagataaagtttctgacaatgcaaagaaagggaggcttgaaatcaaaattagtttctatttcttacataaatgtctggactagaattgtgtccactgctcagatcttacttatattcagggatgacgtatctcatggaagaacagggctcaacgagccacttaaatgtcttcctatcaaatgttaaggttctagaaaccaaatggtgggtatattatccaacatatgccgtgaaagcagagccaatcctgggggaaagcttctctcctaatggtaaggtgtccatatcctctgccccaagaaccaagacaagtgatctgacaagtgtgaagactgcttttcaacatgaaaaagagttttcttaaactcaagcatgatattggctctactttgaatatcagttacgaaaattcataacgagctgaggtatcttcactaacattgcaaattaatttcttgtattcatcacaatgacatttatgtgtatttgaaaagtaatccatatggatgagcatatttttcattcactctacagacggaacatgcacgctggtttgcagatcccttgcagtgactctacagctcccaggaatctgaggttcacaaggtgaaacctaccaggccaaacaatttaaaattggttttgttttgaaaatccagtaagtatgatggcaatgtcttgcagaaattcctcttttagtattccagtctgtgggctctggcagaagtaatagtctgctgcaaacagatcactcttttttgtttgcaaagtcttcgtaccagctgaatcacagcttgcttttcacttttcgtaacaccttgcaacatcgcaaaatatttgctggagtttgtgaagggcggctgcagaattagtaaactgaaaggaggccttcctttactcccaccccttcaatgccgcttgtccttggtctataccttgagtagaaagggactagttaacttgctgtctccttgaatgtgttttctgtgagggtcagccctgaccaccccagtcacaggaatctttctggcctccggattcctagtgctcatattgtatatatcgtccacaaggtacttaggtactgttgtatattggtatgtcccatatgtgcatgtcttctgtccccaaccagattgtaagcccatctgtgtttgctcagccctgtgtgtgcaacagaggtgctgaatgaagacctatcgatgattgattgatacgttaaagattatttcctccttcctcagaatgctacacttcgctcatcaatggagctcaagatgtaaaagtctggtttaagagacattgaatctattctgccttttattatccctttcttataagttgacttttaagaaatcaatgactgtgtggagagttctaactgggtacgtaataaaataaccaactgtgggggtgggcagggggccctatcgcaccaggaagcttgtttattggttgcattagaccactaaagtggaagcactgagatattctggaaagaacacagcttgggggccaacagatctgggttcagagccttactgcatcacctacaagttgtgtctctttagaaaatttacttaaaattactgggaatttatttcatcatctgtacaatgggctacttttttctgtgattgttgtaagaattgtaataactgttaaattatgttgcttatactcttgtggtttaaaatgtgttgcagctgctgctaaattgaaatgatttgggggatcatttggagaagagaggttatcctctggaaatctataggaagttgcaaggattaataaccactaaggagcagaacattgctgggtcagaaaatagctgcaggacttagaggttttctgcaacacaggactttcagcttcaaaactgggacattctcatggcaaactatggcgattggtcacctggcagtgagccagactgggaggatctgatgtacccatggaagttaggccgaaacacttattgaaatctggggtcaatttgaggccttggccacagaccaatgcagaaaaggtgggcaaagcgtggtacaacgagtaccttggtactcagtccctagattaccaacctagagcacctgctgtaggccttgcatgcagaattagttggccccagttctgagggagggctcactagtccctagttcctctcaaaagaatgagggtaataagttatgacatctcctcatagatttgttatgcagattagatgggatagtctatacacagcacttagcaaaggatcagaaacattttaagcactcatacttaaacccaaagtcactcactaggtaattggcgtgataagatacatgggctataattaccaaaaatatagctggtaatttaagaaaatggccaaatgtgcaaggtagtaaaagtctagggtggggcaggggacataaaataccataggaactgaggaacagggggtcaggtctgaagaatctgttttgcatgagacactttgtaggcctttggagagaaattgtgaggaggacttgaaggacggacagttggcccccaaactccaggctttcactccctgaactaagagggaccttgagcaagccttcacctctgggaagaagccctcagcagcccagataggagagctgaggtgtctggaaaagcccacaccgaggcccagggctgggccagttatggaaggccatcagtgcagccccgtcttgactcttgccaagacactaacatatataacaatatgttatgcaacatattgttatagtatatatattagttaaacatatagtgaataatataacaatatactgtgtccataaacaatattttagttctgtcaggtttttatctttaagtgaaggaacacagtatatttttctttttcttggcctttgtcaatatttgtgagattcacccatattgaagcatgtagttattgttcatttttactgccatatggtattgcattggatgaacatatacaaatttacaagtttgtttagtggtggggatggatatttgggttggttattttgaacacatggcacaaaacattcttgtacgtatcttttggtaaagatctttcttatttcatttattcaatgtaccaactcaaatgaaaacgtgcctactacatggcatggaagaaacaggcttcttgtcttatctcgcacagtctgcccacgcaaaccatctgtccagccaaaccaaaatagcactgtgcttccagcctctgcaccctggctcctgccttgtcgctggcttgaaccaccctcccccaactctctgcttaatgaaacttaatcatcctttaatccgaagctcaactgtcctgtcttctatattgccttcctgattattacagcaggaagtaatttctcttgctcgaaatgcagttaattaaaaaaatgggcgactttggtgccatcatactctgccttggattgtagtgttttgttggtgaattttatctccccaagtaagctgtgggcctgaagaaggcagcaactgtatttcacacatcttagtattcctcacagtcttgcgtatgatgtaagctaaatatttattgaatgagtcaatgaaagtgattttcagtgttgag

SEQ ID NO: 791 - DNA, 2126 bp, Homo sapiens
cccatctctggcccatgcagcctgagcccagagttgacaacatgaccatcagtcagtccttccctggacaaacagacaaagctcctcatgccagcacaacacttggtcccagggctggcagccaggagcacagagaagaacccacagacactcacagtgaccccaggaagacagatatccatgcagtgtggcagtgctgtgggatgcaggagcaggctggacctgaggttgcattctgagcaccccagggaccagctgagggcctgcaagcacagcgggtagcctcttttctgggggtagtagcagtggcccctgggacttgcagctgggccctacccagactcccccagggctgtgcagcagtcatccacacttgcagccttctgcagaagactggagtgccagcatccaagggccgagcagtgcaggggcctgactccaactcccctgcctcagagggaggctagctgtggggtcagttgacactccggagtccccatggaatcaggctagacttccgctacaactgcacttctgtccagcctcctcctctccctgcatggtgcttgtccttcccacacagatgtctcctgagagcataccctctctaaaccccttctatcagaatccccagcccatgcactgagtcatagccctcacaggcaggaacgagatgagagggcacagaacaagcactcagaagccaggtgccaccgctgcacgttcaggggctcaataggccagaggaggggggcgtcctcacctccaggaggtggaggtgctccccactggggccatccagctgagccccaaggtgggagtgtgcattcaggaggcacacaggcaggggaaaccactcacaaaggcaggaagggggatggccagctcaggagctggacggaggggcagggcggggacggcaggaaggctcggagagatgaagggaggcaccagagaaccacaccacctgctaacatgctccctagagcacgggagcgacctggcctcaacctctgcctctgcccctctctgcagaccccagaggctcactggcaaaatcagtgtaatgatgctggcatcaaaaagaggcacattaagtcacatgtcagtgaaacgcccagcagagcccttggacagtaggctggtcaggggccctcccagcatctgggtataaatgcacacacccagaatgaatgtgtacacccagagcccccaggcacatgactgtacaccacacccaggcctgggcaccggcagggtggaccgagggcaccagcctccccacacctgctgctccttcctctccactctgcaacctgggccctgcctggcactggtgctgtcctggagatcccctcctgtgtcttcccctgacagcgtccccggttgcctcacataagacagctctgcactcggtgcaccaccggatgcatctggcgtcctgcccagggctgagaacactgtgctgccctggagtccaaccctgggtgctatggcaggccagagagccactgtggaaccctggtccccacgggcaggggctctccagacgtcagcaggcagcagggcatgtagccctcgacggccgtgatccacagcgctcagcattctatttttatcatttaaccccaaactttctattccattgtttctttgacccatcattcaaacatgtgtttcaaattttctaaatatacaactcttttagagttatctattttgttatcactttctctcttaattgcactgtagtcggaacacttggcccgaatagcagcttctttgacatttgtgcgttgagtgtcccaggatgggaggaggagaaccaggggccggccaagcccaggaaatgggtgtctgggaacaaggcagtggacatccacggcggtccaccgggcaggggtggccacagcagcagtcacacccccaccccgtccatcacagcacaggccccgcttgagtcctcacacctgtccactcctggccggtcacccctcacagccctctgtcatggtgcctggaggggagggcctctgacacccccagcaatccaccagtgggtatcagaggccctcctctatggctgtcagcccaccagtgccacttcagtcccctccctccgcaca

SEQ ID NO: 792 - DNA, 1477 bp, Homo sapiens
acacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccac

SEQ ID NO: 793 - DNA, 3379 bp, Homo sapiens
agcagtttgccacgtttaggagctggaggattcacttgccattccacagagttcttcttctttttttttttttttagacaaggtcttgccctgtagcccagggtagattgaagaggggcgattttagctccctgcaacctctgcctcctgggctcaagtgatcctcccacctcagcctcccaagtagagtagctgagtagttgggactacaaacacacgcagccacacccagctaatttttgtattttttgtatggatgggatttcacaatgttgtgcaggctggtctcaaactcctggactcaagcaatctacttgcctcaaaagtgctgggattacaggtatgagtcactgcgcctggcccaaagagttcattaacgcttcttgatctaaaataattactcctttcttctcttggacaattcaagaaaaaaagatatatagctattcatgaatgaaaaaaaaaagcttctcttatcttaggcagtgagacattaagatttataaaactatatactcccatcctgagctaaaaccacaaacagtattttgacataactgtgctagaaggaaggaaattgggaattatattccaatggtaataactactattattctcaaagtatgttcatacctctacaattttatctttacagacatatgttagcagagacatatttggacccaacctatatactttttctctataaagcattcaaagaacaatgtgacgattacagttgtgtggtaagaaatattaatataaagaatgtattaactgtaaattgattgttaaagatattttacacattgtggttgttatgttgtacaaatgtcaaaaaataatcttgggataaattgcttacttataatcacttgattaattgcaatttttttgtgtgtgtcagatatgcttttatttcatcctgatgactagctattcagagataaatgtaatgcttacagtacctatattatcctagatttctttctggtttacttaataacattttaatttttaatatctattttaaaaattttactctacttgtatcttttaaaagactctaattcttcctgaaagcagaaatgtatagtaaaataggagaaatcattcttacatgatatggttttacatgatatccagaatgctgctggcttccagtttttttgtttgtttgtttgtttgtttgtttgtttatggtgtcttgctctgttgccaggctgcagtgcagtggcgcgatctcagctcactgcaacctccgcctcccaggttcaagtgtttctcccctctcagtttcccaagtagctgggactacaggcacacaccaccacgcctgctcatttttgtatttttagtagagacagggtttcaccatgttagtcaggatggttttgatctcttaacctcgtgatccgcctgcctccgcctcccaaagtgctgggatgacaggcgtgagccaccgtgcccagtcacttccaattttaaaatagagaattcgactggctaggccaatgtctctttgagttctcacactaagtttttcttgttgggtagttgaattagaagaagttatcctaggaatttaggttaggcatggtggctcacgccttccatcccagcactttgaggggccaatgggggcagactggttgagccccagagttctagacaagccagcctggacaacggtgaaacctcatatctacaaaaattacaaaaattagccaggcatggtggcacatgcctgtagtcccagctactcaggaggctgaggtaggaggatagattgagtcccgaaagtcaaggctgcagtgagctgtgaaggtgacactgcactccaggctgggtgacagaacactgagcaagaccctgtctccattaaaaaagaaaaaaaggaaaaagaaaatttcttctaggaatctagtctctaaatacacttatgggtattttctcatctactctttcaaattctgatgattccttttacaactcaatagtagattaggacagagtttccaagttattcaactgagatagaatttgaacattattcatgatttttggctaagacagtctaggcagagagcagctgtggcaatcagaattcttagcaattgcctgactactactagtctgacagagatcttcctttggccaatgatttctcttttctctcatcttcattttcttgcctctcctttgcactacctccatcctgtaaccctaatcagatcgtccacaattccagagccccagttccttttataatataattatatataattataataaaagttactttttaaattgagggcatactctattagagccactctgctaaccattttgcatgcattacgatgcagtctcatgttttatggattgagtgaccatgtgttctgtttttcaagaacaattctatttatcttgattgtactggtatacttaatcatagtgctccctttcattctcagaagtgacctggttaggacaataaccgatatgatcattacatattttattagcttcccagggctgttataacaaattacaaaacacttagtggcttaaaacaataaaaatttattctttcacagttctggaggcaacacgtctgaaatcaaggtgtcagcagggctccctcccaaggctgtaggggaaagtccttctatccctcttccagtttctgctggtgcctgactctcttgatttgtgacagaataactccagtctctgcctccatcttcacatggccttctccatgtctctgtgtccttttctcttctgtttcttataaggacactttctcttggatgacaatgacagataatctttctaatccacataatcttatctcaacatccatcctcaccttaccttaacttaccttatctgtaaagaccttcattctaaattaggtcactttctgaggttttaggtagacatatcttttgggggctataattcaaccaatgacctatagatacatgtagtaagtttttaaactggcatattaaaaatatgccttgttaaaattgcctttgaaaaatatctccatatctgtgagggattgcttccaggaccctcactaataaccaaagtcttagcataatcaaatgctgtagctggcgctgcagagcccatggatacaaaaagtcatcattccttatacgtgagtttcacatctcgagaatactgcacttcccacctgcattttgttgccaatgtggaacctgacaatgtggaggcctgactgcacttattgaaaaaaaatccgccataagcgggatttgaactgcccattcagttcaaacccgtgttgtgtaagagtcaactgtataaaataatttttattcacattaaaatttgaaactgc

SEQ ID NO: 794 - DNA, 1492 bp, Homo sapiens
tcacgcctgtaatctcagcactttgggaggctgtggtaggcagatcacttgaggtcaggagttcaagaccagcctggccaacatggtgaaaacccatctctactaaaaatacaaaaattagctgggcatggtggtgcatgcctgtagtcccagctacttgggaggctgcggcagtagaatcgcttgaacctggaaggcagaggttgcagtgagctgagatctcatcattgtactccagcctgggtgacagagcgagactccgtgtcaacaataaataaaataaaataagaatttattttagtgtattcatgaaaattgattttatttacttttagttaatgtttacagagactggaaaaacttctgactttatatacattttcataaacatttttctttcaaatgaacccttgaatctacacattgagagccttatgggtaaatacttaaataatgacaacacacttatatagtattttctacatgccaggcactgttctaacccttcttacatatatgagatcatttaatcattatcaccattttacacatgaggaccttaaggaacaatgaagttaaagtaacttgctgaaggttgcattgctggtaattgatggggcgtggaactgaacagtctggctgccgagccagtgtttttaaccactgtattatattgtttcatatttaaatgacttcataccatgatattgtgacagtttataattggaacaagattcattctaggaagaatttatatggagtatttctaagaaaaaactgtgaaatagaaaagtaagtcagaagtgtgttaagtgtgtttagcaggttattagcttcctgctctattataaactgatacccacttaacaattttagttattttttaaaagttgtatattttgtatataacaactctgctgatgtagtcagtaattagttgtcagagttataatttctgtttggtttgtttttttcattaaaccaagaatcttatccattttatatccctactgttcaggcacataatttgttacaattgtttttaaaaaatgcacaggagttgaacttaatatgtggctcacagtgttttgcccattataggtactcaacaagtgtttattgagatattgtgttaaataataaattgaactaaaggtacaaccaagaatataaattttagtaggagaactttattctcttttattaaaatttaaacgtagaaagttgtatgatccaagatgggttattatctgggaagaatttaatattcttagaaccatattgttgaaaatagctcttagtaattcccactagactgtggcctcctttgagggcagagactaatttatttatcattatctcagcacctagcacaatacttgaaacataataagtattccgtagtatttgataaatgcatgaatatatttaatattatatttgagaacatgtgatatatcatataccatgtaataaattaattttgtctgtt

SEQ ID NO: 795 - DNA, 910 bp, Homo sapiens
tttagctgtcagggatcctgttgcagctctgcctcagccagtctgtgcacagagcatggagcaccagggccatggagcatgtgggctatggaatcgggttgcctattttcatcttgactccatcacttgctgggcaaccttgactcaatgaatgacatcataaaaatggaacattcaaatgagaatgtccaaggacctgctgacttcactgatgaattctaccaaatatttaaagaagaactcatattttccaaaaaaccaaagaggaaggaatacttccaaactctttttacaaggcaagcattaccctgataacaaaactagacaaggacactgcaagaagagaaaattatagtccagtatgcttcaagaacataaatgcaaaaatcttcaacaaagtaccagcaaaccaaattcaatagcacattagaaagaccattcaccgtgattacatgggatttaaccctagggtgcaaggatggctcaacatatgcaaatcaataaatgttatacaccatattaacagaagggataaaaaccatatgatcatctcaatagtttcagaaaaagcatttgacaaaatgcaacattttttcctgattaaaaactctcaacagattcggtatagaagaaatgtacctcaacacaatgaagcccatatactgcaaacccatagctaacatccaactcagtggtgaaaagttcagagatttttcctctaatatcaggttcaagaccaggatgcccactctcatcacttctatttaacatagtactggaatttctagccagagcaattagacaaaggaaggaagtaaaagatgccaagaacacacaatggggagagaagactttgctaagttgtgctcagaaaactggatattcacatgcagaagaataaaattagacc

SEQ ID NO: 796 - DNA, 3022 bp, Homo sapiens
tgggaggaagccccttcacctgatgtcaaggggagctggtggccggggttttaccacacagcccttcagcatcacccctgaggtcacgtgggtgagcaatgcctcagtgggctgggggtaagaggtgcctcagtgggggccggggggtgtgagtggtgcctcagtgggccgggggtgaatggtgcctgcacagctgtgcggggtgtgcctgggtgggtagtggagcttcctcagcagagaatggggtgtggggatctcagggctgcattcccagactctgcagagagtgaactctggagagtgaggccctggggttctgttgttctctgggaggaatggggttggggccctcgtcagcagggcccatgggcaccacagtgagaccctgggctgcctccacacgaggactcaccttctcccccttggggccatcgctgcctgggctgcccttggtgccggggtctcccctgcgcccctgcagagaacaggcgtgtgggtgagggagggggctgagtccaagcccagagcctgtggagggtgggggctgtgccggggccgatgctccttctctacaggagggctctggctttgggacctgggacctcgatccccaggctccttcccaacagcctcagcctgcgccagtggctctgctgccagccctcgtccctctgctgcgtcggtcccgcccatgccgaggatttaggaatgatctggggaggctccaggtggagttggatgtctgagcccaatgcggcaccatggtgacagcagagatggtggccagcgtgactgttcatctgggccatgggcgtgagtgtggccagctcagctgcaggcgaagaggcagaggggctcaccttgcttcccttggccccgatttctcccgggggccctctgcgtcctgggcggccagggtccccctggaagggtttgcagaatcagcctcacgtcttttggcaggggaaggggggtgcaggatgcccgctgcgggggcaggacccacggtcgggcttgggactgcacctccctgatgtccacggggcacctgggatgccagatgctggctgggggctgctggaacctccgtgccagctgagggcagagtgtgtgtcacgggcaggacgcctgtgcatctgctcagaggactcagccagacttgggcttgggctgagggaaggtggacagaaagtgggaagccctaagtccaagctcccagaaaaaagcccttggggatcctggggccgccaggggcggggcgacactgcaggcggcccaggagggcagagcccctggggcaccaacgttcccatggggagctccaggaggtgtgggtggggctccctggggctccacctgggaggaggtgggtttgttgccgaggcctcggtgagcagcggcggggccgcccaagccctggttagaagctgatgaagcaacgggcagggcaccctccaccacatcccacggccattggctcctcactgaccagtgtttccagaaaggccctctctgctcagcttctcagctggggctgcctccaggaggcccctggaagctggtgaccccgcctgccccgtaccctgacaaggccacttaccttgccgccttggtctcctcgctcccctggactccctgcttcccccgggtaaccgtcggggccctgagagaggagtgagaggtggagctcggcacacggcgggtggggttctccccatgagccagggcccaagtgctccattgtcccagcccgggacgcacctcccaccctcactgtgaggcccaggctcagtgaccaagaggccaggcctggatctgctgctcagggaaatggagctgtccagtgacaccgaagtttgggatgcatcaggtctccaggccacggggatccgccaggagctcccagggggagttcctcacatgactccgacccggcagaatgctgggctggggctgctgggctggggctgctgggctgccgggagaacccacgctcccactgcagcagcaactaccctcccacccggtcaggcacccacaccccctgggccgaggctgaaggaggggtgcaaacggcccttacccggtttccagggtctcccttgcagccaggaggtccgatgcgccccagcttgccctgaaggagaagggggcaggaggagtctcagggcggggttctggggtccatgtgtgccaacgaccaagacacagcccacccggttctgccccgcagggctgcagcgctctcctcctggcacacgggtgcccacatgaggccacggctgctgtggagctgtctccggggaggcagagtggccgttgtgcaggaacaggccatccctggctgcctcccagaggccctgagggcagagctccctgggcacagaggatgttcccacggggagccatggaaggagtgggtggggctgtcctgtggtttgacctgggagtgggtaggcttgttgctggcctctgtgtgcagctgtggagctgccccaagccgggatgtgcagccatgaattagatgcaggctggtgaagccctgggtggggcagtgggatgtggcaggagctgaagttcgtgtgtgtgtgtgtgtgtgtgtgtgtgtgtatgcgtgtgtacacatgtgtaagctgacagatcaggctggatctgggggccctgcagaggctgggatgcctctgtgagaccagtccagctgtgagcccgaggctccctctaccttctgtccatcggtcccgttcttgccagccaggccaggggccccctgaagagagaaggaagagggaactccattagccccggtccttctgccctgagcagcaggaaggaggggctctgcctacccagccagcctaccttgcgaccgtcggctccaaattcaccctgtgtaggaggaaagccggcgcagtgagctcggtgcctcaaagcatcatgggcactgctgcctctggggggcaaagcccttgggccaaactcaaggccacaggaccccccaggagcccccaaagccaccactgag

SEQ ID NO: 797 - DNA, 2300 bp, Homo sapiens
cctctgctggtggaggacaatgaaatgatggctttgaagctgacaacaccatgggatggctgcggtgggctagggaaaggagggtgtgcagcaggcacataaactttctagagtagtgtgggttgcaccactgcaggcatgaggtggggcgccccggtgtcacaaaagtccgatcaggggacatatggtcctgccaggagctaagggcccagagcttggccaccgtgcagagagctgggcgaagaggaagcgccgcagccagtggacttggttccactcagctgcaaaaggaagagagttggtcaagacgacgtctgcagtcccttcactataaaattttgcaaaatacaaactgctcagtgggtgtgtagttggccgaaggtactccaccaaagaggtaccaaaagctggtgggcttcaaagcagcatcgtccccagcagccaaaaagtgggcaccccaagtgtccatccacagatgatgggtaaacaaaacggggcctgtccatgctaggaaatatgacttggccatcaaagggaatggagctctgacacatgccacacgtggaccttgaggacatcatgctgagtgaaacaggccagtcacaaaagcacaagcacaggatgattccacttatatgaggtccctagagtagtcaaattcatcgaaagtagaatggtggctggcaggatctgggggaggggagtggggagttagtgtctaatgggtacagagcttcagtttgggaaaagttctggtgttggctggtggtgatgattgcacaacaatgtgaatgtacccaatgccactgaactgtacacttagaaatagttaagaaggtaaaatttattaagtatattttagtaacccctccccccgcccccgccaaaaaaaaaaagcccatgtgcacagtggtctctgctgaatgaagacttgaaaaccagagcccagccctaaacagctcatgcatagtccaggcagagaaacagagcaggtaatgccccctcaactgatggcagacgggccagggagccctgctctgggctggagcagggaggcaccttcagggttgtgggagatctgcagggagagccacttctccctaggggtgggtgtctgagcaacagcaccagaatcccagcgacattctctccttcctccttccagactggctttgcctgcctctgaggctctgggaatgctgttccctccacttggaaggcagtttcctcacttcaccaattctttatcttcgtcatcccaaacccaacccacatgcaccccacaagaaaacctccccttgccagttatagactctcaaatcccccagaaattctgccctctgatgttgatcataattgtcatgaaatagctatttgtgtcattgtgtgacacgttctatgaaattctccattgcttccccagtactcattaaggaaatgctttttgtcagatggacagatggatggttgggtgagtggatggatggatgaatgatggatggatggatggttggatggatggatggaagcatggatagatggatggatgggtggatggatggatggtggatgtgtggatggatggatggatgaacagatgggtggatggatggatggatggatggatggatggttggatggatggatggatggatggtggatgtgtggatggatgaatggatgaacagatgggtggatggatggatggatggatgcatggatggatggatggatggatggacggatggacggatggatggacagatggatggatggatggatgggtgggtggatggatgataggtggatggatggatggatggatggatggtggttgggtggatggatggtggatgggtggatggatggacaatgggtggatggataggcaagcaaactgaagggtctacccacccaaaggggccaatgcatggagtgcctaggcctggataacagggtgcaagtatacgtgtgaatgggtgctttcgagtcttttgcctagaaccatgaattacagttcaggcccactgtcagtcctacctgacactgtgtggactgtggacctgtctgagaacggcttcctggatctagaggtttggctgaaggacagcactcaccatctcctgggaggatgagctctcaatctgatctgatctgattggcttggaggacccatcccagatggcaccatccaactgtacctagcacttgctgtgacctgggctggcactagctgagcacttcccatagaatagcaggagctacttttccctgttttacagacatggaaactgaggcac

SEQ ID NO: 798 - DNA, 1614 bp, Homo sapiens
aagggggcagccaacaggaggctggtagaggagcttgaagaagctgcaaatgcggaatgaaagcctcccgcaacatccaggttgaagaagctaatttattgactcggcaagggcttattgtccctgacaacctccataggataaggcggccttcagaatcaaaatcaacctatgagaagattacccattcaaatcataaaagaccagatttaaaacaaagatctatcacccgaacatcgactagaagtggaggtccgtctgcttggaaattagtactgagaagagaaagccagcaaccagggatgaccacacactccagtccagcattggttacccagcctgagcatctgctcagcctgacactcctggctcacctagccgaataatactttatgaaatgctgaagagtttacaaggaaacatggggaaagcgacctgtggacaaaagtctgccagggtgcattccaccacgtgtgagcagagcctccgcagtgtgctccaacactctgcaaagcaggactgtggagaaaggacacatccatcccctgccttttgcttgtggtagtgactaactttctacagttttctcaatcaacagtggtccaagtaaactgtaattaaaggattaaaaatgaaagatgctccagttctgctttctttgttttaaaaatcactgctgcaatctgcttcaaaacaacagtgcttcttttcttgcccaaatttattcaaaatcttcaagttgtgtttagccgagaaggctctgcaaaggagaagagacggctctggtgtctctggtgggttttcttctcccgtactgcactgctcagtgtgggagttaattcaaattctcctgactccagattataacatccttttgaaaaatttgaaaacaagcaaacaacaacagccctcctatcctgactcccttctccaaaaacaacaacaaaaagccatgaaaaggcaaggcctagctctggagtaaaattcctgctaatattaccccagtaatatcgatgaaatgggcaaaccctgatgtcagtgcatgattgaactctagcacggccggcccctgcaaatgtaggtctgcggtgaccccgaagggagggcctgccaaccagggccactgtgcatgctgggtgtgatgaatctctcaccagaaaggctcctgaggccaaaggctggcactcttccctgaatccattttggaagacttgctggtcattgcaggcaaagctaagccagactatccctttgaaattccaagctcatctgtcaccaggctccatcccagtgtgccactgagctcactcttcaactcctcagggtggcaaccccaccacagctctccctgagcacaatttgaccttttgcatgattgaaattggtggaagtaagatattagccggcaccagtctgggattgccagtcccttgctgtcccctttattctttccttcaatgcagcccaggagcaagatggccttccctctccctttggactcaccgcttttgcagactcaagctccacttaaagcttactcagtattatcctttaaacgtgttttatattgttttgcctgcttttttgtgtgaaataaaaattaaccttagaatt

SEQ ID NO: 799 - DNA, 2570 bp, Homo sapiens
gaagtacaatgttttataggttgtaattcagaaatacaagtacataagaaccatctgttagaggatatgccactgaaagggacaaccgactaatttaaaaattatctattgggtgatatgattaacaatatttcaaagaatttttttaagtgtttggttcttattaacggactggtatttcatttctgaccagtatcatgtaaaagcttccctaaaatttttattctggtttacacggattagcataaagatagagcaaaaatttcatctttgaaggagatctggttagatccatggatatctgaatggcattgatttataaaccaacattattacttgtgcgttaataatgaaatctaaaacttagtataagttcttaaatgaaattcatttgactttctgatatgagtgactcttaaggttagaaacatatgaatttagaaaaatgaaaccaaatgttttcaacaaagtaatttatttttttcctgagactaaattcagtacagtatttgtttttataacatccaacatgtcttatgttaaacttaaccactttctatgcagtgactgtggtgagatgatctattttatttgactaccctcaatgtaattcatttgggtagttctaaggcatatcagtgatcaaaatgtttctccctacagttactcttgcattctcaatcagtttcttctgcacatcatctaaagaaaatttatgtggtatgattacactctttttttttttaataccagaatttctaaaactaagaaaaacactaacatttaaaacatcagtgtttctagtcaaggatatttcaattaaatttcatcagtacattatagtttaactcatgctagaaatgttaaaacccaagatcttctgagtcacataataccaacatttcatattaacgaataaattactcaagttctatacaaagatactaagtgatgagaaacagaaaaagttaagctttcaatagttttaaaaaaatacagaagcaaactaatgaacacaactacgcaaaatataggctaaccaattgcaagctaaactagttagagattaacctttaaaaaatacattttagaacttagaagcaaactaatgaacacaactacacaaaatatacactaaccaattgcaagctaaactagttagagattaacctttaaaaaaatacattttagaacttcgtgacaccctcataaaaggcagcaaactaagggtattaaaacagtagtcattatttcagttactgtgcatcaagtctaaaagatccagataaagggaatgttttgtgattcaatttaaataactttaaaattggaaacatttaacaattgataatataattaaaatttaaagaatatacacaaatgatctgaataggttttatattcagtaacttgcatggtttttacactgacacttttatcattaatttaggagaatcagatgcatttccctccatatacctaggcattaagattccaaatttataaatatggtagtatagtattttaaatattaagtttgtacatgaatattgggtttatccgtattttcctttgtttcccaggtattatccagttttgtaaggaaaacactttgatatcacaatcaaaacttgtcttggttactaggctgtagccgtaattgggttacagtcacttagattcattatttggaattatacttaactaagacaaacctaaatgaaatttatctcctagaagaatttcacatttgcatttacctgcatggcagaatgagtttaagcacattttagctgttaggaaatatttaatttacttaaacttgttatctgactactcagaactctgagtagtcaactgtacctttgcgtttacttaaaactatatcggattcacttcaaatagaagatttttaaatagaagttagacttcattaaggtactggtattaactttaaatctgaaagaaaacatactgaaagtttgacaagttcattaaaacatttttagcatgtcttggtatatttatcagctttttattcttctttctgctggcatttccttaatgtttgtttgtttcacctctctggttcattggattgctactatttatgctttcatggactttatcttcacagtttactgtatcttgtaaaggctttaccacatcagctgtactggctgtttttggcaaggtcatctgcagtgcacaccacagggcagtgcgtgttttccgagtagccacacacatctctttaattgcagaagcaagggcaaaaacatctgtaaaataaacattcagggtcatttcatattaaatgccatttaaatatctgttaaatcttacaaaacccagtgcttttgctactaaatgatcaaatgttatttttgtaaaaaaaggatagttattgattgaaccaaagtcctgtcctttatcattaaaatatttaaaagtattgatactttatttctgacttgtacaatagtgactatagtttgagtagaacacagactgtcttgaaacagttataacagacaaaattaataaaatggaaatacttttggagtaaa

SEQ ID NO: 800 - DNA, 2569 bp, Homo sapiens
gaagtacaatgttttataggttgtaattcagaaatacaagtacataagaaccatctgttagaggatatgccactgaaagggacaaccgactaatttaaaaattatctattgggtgatatgattaacaatatttcaaagaatttttttaagtgtttggttcttattaacggactggtatttcatttctgaccagtatcatgtaaaagcttccctaaaatttttattctggtttacacggattagcataaagatagagcaaaaatttcatctttgaaggagatctggttagatccatggatatctgaatggcattgatttataaaccaacattattacttgtgcgttaataatgaaatctaaaacttagtataagttcttaaatgaaattcatttgactttctgatatgagtgactcttaaggttagaaacatatgaatttagaaaaatgaaaccaaatgttttcaacaaagtaatttatttttttcctgagactaaattcagtacagtatttgtttttataacatccaacatgtcttatgttaaacttaaccactttctatgcagtgactgtggtgagatgatctattttatttgactaccctcaatgtaattcatttgggtagttctaaggcatatcagtgatcaaaatgtttctccctacagttactcttgcattctcaatcagtttcttctgcacatcatctaaagaaaatttatgtggtatgattacactctttttttttttaataccagaatttctaaaactaagaaaaacactaacatttaaaacatcagtgtttctagtcaaggatatttcaattaaatttcatcagtacattatagtttaactcatgctagaaatgttaaaacccaagatcttctgagtcacataataccaacatttcatattaacgaataaattactcaagttctatacaaagatactaagtgatgagaaacagaaaaagttaagctttcaatagttttaaaaaaatacagaagcaaactaatgaacacaactacgcaaaatataggctaaccaattgcaagctaaactagttagagattaacctttaaaaaatacattttagaacttagaagcaaactaatgaacacaactacacaaaatatacactaaccaattgcaagctaaactagttagagattaacctttaaaaaaatacattttagaacttcgtgacaccctcataaaaggcagcaaactaagggtattaaaacagtagtcattatttcagttactgtgcatcaagtctaaaagatccagataaagggaatgttttgtgattcaatttaaataactttaaaattggaaacatttaacaattgataatataattaaaatttaaagaatatacacaaatgatctgaataggttttatattcagtaacttgcatggtttttacactgacacttttatcattaatttaggagaatcagatgcatttccctccatatacctaggcattaagattccaaatttataaatatggtagtatagtattttaaatattaagtttgtacatgaatattgggtttatccgtattttcctttgtttcccaggtattatccagttttgtaaggaaaacactttgatatcacaatcaaaacttgtcttggttactaggctgtagccgtaattgggttacagtcacttagattcattatttggaattatacttaactaagacaaacctaaatgaaatttatctcctagaagaatttcacatttgcatttacctgcatggcagaatgagtttaagcacattttagctgttaggaaatatttaatttacttaaacttgttatctgactactcagaactctgagtagtcaactgtacctttgcgtttacttaaaactatatcggattcacttcaaatagaagatttttaaatagaagttagacttcattaaggtactggtattaactttaaatctgaaagaaaacatactgaaagtttgacaagttcattaaaacatttttagcatgtcttggtatatttatcagctttttattcttctttctgctggcatttccttaatgtttgtttgtttcacctctctggttcattggattgctactatttatgctttcatggactttatcttcacagtttactgtatcttgtaaaggctttaccacatcagctgtactggctgtttttggcaaggtcatctgcagtgcacaccacagggcagtgcgtgttttccgagtagccacacacatctctttaattgcagaagcaagggcaaaaacatctgtaaaataaacattcagggtcatttcatattaaatgccatttaaatatctgttaaatcttacaaaacccagtgcttttgctactaaatgatcaaatgttatttttgtaaaaaaaggatagttattgattgaaccaaagtcctgtcctttatcattaaaatatttaaaagtattgatactttatttctgacttgtacaatagtgactatagtttgagtagaacacagactgtcttgaaacagttataacagacaaaattaataaaatggaaatacttttggagtaa

SEQ ID NO: 801 - DNA, 1711 bp, Homo sapiens
accatcatgttaccatattcttgccaaaaaaaaaaaaaaaaaacaccagagtcgttacatgaagtatctttgatcactgaatttccagcacttctttgttgtgtctagatgctaagcccttttctaatttgaaaaaaaaaaaacaaaaaactggagacctgattctgtttatctcttgtagtttctcttatctctgtttctaaccactctatgtagtgcctctttttttctgtctacacacacacggagcatccaccataccaataatcacagtatgtggtaatgaaaagtggaagggaaaaatggcccttgcttctcacagacaaactcactatctcaatggatcatttttgtttttttgttttgttttgtttttgagacagtctcactctgttgcgcaggctggagtgcagtagtgcaatcttagctcactacaacctctgcccccgggttcaagcaattctcctgcctcagcctcctgagtagctgggattacggcacctgccaccatgccctgctaatttttgtttttttagtagagatggggtttcaccatgttggccaggctggtctcgaactcctgacctcaagtgatctgcccgcctcggcctcccaaagtgctgaaattacaggcatgagccacagcgccccgcctcaatggatcctgatgagctacgcaaaccattatttttatgtctttatgaatgccaccagaaagtttcattttgttctttctgaaaacaaccatgattataagatgtcttctgaaacacggaagtgagagaacatgttgtacagagaagcatgcatccctctgccctgccaccactgcacctatgctaagcatattatagacagaaggatgtccatctgcctatgtaagctcttgcccgtttattcttgggctctgtccaggctgtgaccctattactcctttgctccttcatttgaggactatgactgtgaactgtatttcttcctctctgcacctatataggctacaggaggaagtaacaaaaatcttcccccacacccagagctaaatattttttgccccaagctgaaagttctctagtgaaaatgcagttcaaggccatagatgcaggagagaagtagatttgttggcttctaaaaggaatatttatacagttttgtctaacagcaccatcctaacagcattctgatttgttttattttccatttttaatacctttgttgatgtgtaatttacatacagtaaactacacacttaatgtatacaatattataagtttttatgtacatgtgtactcgagaaaccatcaccactatcaagataataaacatccatcaccccttggagaaatcacgttgcaatccctctcttgtgcccctacctacattctccgttctaaggaactgctgatcttctttctgtctctgtagattagtttgcattttctagaattttatataaatggagccatataatatgtactctttttttggtctggattctttccatcaacataattatcttgagatttatccattttttgcatgtttcaatagtttatgcctttttattgctcaacagtattccattgtatgtatataccacagactgtttatccatttgcctgtagatggatatttgggttgtttctagttttgttgttgttgttgttgttgttgttaccaataaagctgctgtgaacatttggcaccagtc

SEQ ID NO: 802 - DNA, 6952 bp, Homo sapiens
ggaggcctccccacgcacgctgtggagaagagagttaaaaaacaattcggttggctgaagcctgtgtcagttttcatgtgacccgccttttggaggcatgacaacacaaaaaaaaggggctgttctcgcgagactctaaagcgacggttaagggacaggggacgagtggagcaagtgggccttaatctgaaaataacttgattgtttaatgacattaagagaaaaagattacgagctttgagaaggaggaagcctgggagtaacgacagttaaggagttagcttgcggaaccaacataagaatttataacagggaggtgtcgtttgggatcagacgcgtggcctgcattgccgtagccaccgtggtgtaatgttgccacgtaaaaaccacaaatcccagaattcagtcgggtgatacactggctcagaatgtgattggctgcgggaactagtagcttcctcattggctcccgtggaaggagtgaatgctgggatttgcagtctgatgggggagccgtgctgggtaaaaaccttagaatcgtcgcgcactccgtttctgccgcggattcttatattctccaatacaggctttttctgttatgcagtatttgcagagcaggctgctgcagtttggccaggcgcattgcggatcagttggtgttcttgccagaggcctagcagcagcttcctagcgctactacttgcacctcccaaggcagctgagcctccccacttctctggccagacacactcctaccgtgcatcgtagaaccacctctctgacgccagcaggaccttagtaagagtaatgggtatgcgacagatggctgtagtcaggccctactgatttcaaaatagctaaaagactatctctgtagttagcttttgtggccttgatggacctgcagctgtgtattgctccctcagacgtacaaattcgtggagatgagttatgaaagtatttagtatccaagtttttcatctgcttaatatttgggattttaaacacaagttttgccagctaggggtcaacatccctgaaagtgttagggatggagctagctgacaggcctttctaaaagaacagagagcctggtgaagagatgaaaaatcaatctcacttgatactcctgttaaaaacaacaacaaacctttaaatagctctctactaacacataactcaaatccgatcaaatctacctgacctttaccattgttttctgtattcatcaactattactgagtacttcaaagtcaggcaataggagttaataaaacagatgaaacttggtttagcctcataatatgtgtttaaatttcacacatacctctgatctgctctcatgtatccttctacttgaatgtatgtaatataaaggccgggtgcggtggctcatgcctgtaaccccaccactttgggaggccgaggcgggcagatcagggcatcaggagttcgagaccagcctggccaatatggtgaaaccccatctctactaaaaatacaaaaattagctgggcatggtggcgcgcctgtagtcacagctactcgggaggctgacgtagaaaaattgcttgaacccaggaggcggaggttgcagtgagccgagatcgtgccactgcactccagcctgggcgacagagtgagacaacgtcttaaaatgataataataatatatacgtaatatatgatattttttctccccagtaatgccatatttcattttaccaatctgccatgattaatatatctttcatcaaactgtccttagtgcttcagccacaattaattgccttttgctctgaatagcctttccaccatatttaatgtaaaacacacacacacacacacacacacaaagaagcaggtctttttttgtatgtgtggacctcaaggcctcagtcatttggtattatcaataatactttcttttagcctgtgtccactcagaaagcaaatcatggtttgtctttttctgtgtgtaaattctttcacttttgaatttccagctgaactataatatttggagtcagattccttaaatataaatcatgtttacagccacttacttggtgtcataggcaattcattttcatctttctcaacttcagtttcttcgtgggtaaatgatgatcaggatattacctcaggttgttttaagagttaaataactcctaacctcaggtgatccactggcctcagcctcccaaagtgctgggactacaggcatgagccaccacgcccggcccagccaaatatggtgaaaccctttctctactaaaaatacaaaaattagctgggcagatgataaggagaaaataatgaatgtcaaaggaaacgtaattcctccagtgctggttgtctcaactgcgattgttgtggtttggaaatgtatcaacacccaagaaggctctctcttgtggatgtatcacttaaaacacccagaagttgttgacggcggcgggcagaagggccggtggtttccaagctgcttcaacaatgggacccacaatcctcaagcagaggaagaagaagacatagacaaagaaaaagagaaagaaaaaagaaaagaagatgacaaaaaaagagcttcggctatggaactggtttaatccatacgatcgcccagaggtgctgacggtgaccagctggaatgagccggttgtgtgggaaggcacttagaacagaaccatcctagaaaattattatgccaaacagaaaattactgtgggttgacggtttttgctgtcggaagacatgtagagtattacttgaaggagttcatagcatctgctgataggtacttcatggtaagccacaaagtcatgttttacatcatggccgataatccaggatgctgttgatagagctgggtcctctgcgtttcttcagagtgtttgagatcaagcccgagaagaggtagcaggtcatcagcatcgtgggcatgaagaccaacagggagcacatgttggcccacatccaacaggaagttgacttcctcttctgcatggatgtggaccaagtgttccaagacaattttggagtggagaccctgggccagtccgtggctcagctataggcctggtggtactggacacatcctgaggagaatacttaggagaggcagaaggagtcggtggcatacattccatttggccagggggatttttattaccacgcagccatttttggtggaacacccattcactttctcaacatcacccaggagtgctttaagggaatcctccaggacaggaaaaatgacctcgaagccaagtggcatgataaagccacctaaacaagtatttcttcctcaacataccctctaagatcttatcaccagaatgctgctgggattatcattataggtcatcatgcagatattaaaattgtcaagctatcttggcagcaaaaagaatatacgttggttagaaatgatgactgacttcaaattgtgccaacagttttttgaatttgagagaattattattctggctacttcctcagaaaacaattttaactttaagaaaatattaatgaaacaccaacattgcaatcacatactatctctccttgtaactttgagcattgtaatatgagagaatgaatctatggtaatcaggtgtaaattcccagtgatttcttatgtattctgaatttgggggaaatactatcagctgaaccagaaagaacttgtcataggcaaagataaagccagaaacaggccaggcacggcggcttatgcctgtaatcccagtactttgggaggccaagggagtggatcacctgaggtcaggagttcgagaccagcttggccaacatggtgaaatcccgtctctactaaaaatacaaaaaattagccgggcatggtggcgcacacctgtaatcccacctactcaggaggctgaggcgggagaatcacttgaacctgggaggcagaggttgcattgagccagattgtaccattgtactccagcctgggcagcaagagtgaaattccatctaaaaacaaacaaacaaaactctacatgtgtcagataacatcctggagaaaatcaggtggtaagggaagtgttggcagcgagatatggttgtagggggttatacccttgattccaatgttttcctgtttccgatggatctaaagaacatggagtttttatttgcagcaggggaactttcagtaaggacaccgtttgccttggcaatcctcaaaatacttcaagaacagattgtttcagaccatctgtagtccattcttttctcatcaggatgtcatttggtttctgtgtgaaagtttggtggagattcccagtagatattatgatggtgcatggtcagagtcccagggaacctgaatgaaccaaggtgctcaatgtgaagtgaaaacagcctcaacatgagtgccatgaaatagcaaagagagagtgcaagagaggggctgatcgctgtggggcagtgccaccttgcaggaacacatgccatgaggttggtgcttaaatacatcatggatccaggcactgaatgggaggcagtatgggtgatttccagcttggttgaccccatgactgacaaacagcagggacttgaatggaagatgcttcttgttttgcccaagttgtattcggtctaccagattctgcaacttatgtcttcagatccttggtgaggagatatggatgctgtcagagaaggcaaatgcctgcagtggatcgaagaggttttcaaggagttccatttccagaatgtggcttcatcagaggacaatggatcatcagctagtcccaccacttagctattctggaactcagggttcctgtgccactcataccccaacttggagggctgacatcaaagagtaaactgaagaaatcaagtaacctctcatttttcatctgcactatggaagtgtaacaactagacgtgtaaccagcaaaagggttcggccatttgtttatagaaaggagtcaaaataataatgacatgtgaaagaaagagagcaagactttactacttgtgttagcaaggggaagaatgggtgaaattttaaaaaatttccactcttccctttgtggagggaagatagagatttttaaggagagaggggtttggaatgtaggagaggaagtgggtatgaggtggcacggtttgttttaatgacttattgtgaattgttgttttatttggtgaaggccctggtgtcattttgggctttaattaggttacaaattaattgcagtcaattttatggtcaatttttgttttttcttggagatggggtctcactctgtctcccaggctggagtgcagtggtgtgatcttggctcaatgcagtcttgacctcccaggctcaggtgatcctctcctacctcagcctccctagtagctaggaccacaggcatgcaccatccagcacagctaactttttgtatttttttttggtggagatggggtttcaccatgttgcccagactagtctcaaatttctgggctcaagcagtcctcccacctcggcctcacgaagtgctgggataacaggtgtgagcctttgcatctggcctgtagtcagtttttagctgggattgagtttcagccttgactggggagagaattttggaggtgtctggtttgtgttaggatttggcctttgacgttttaatggaaatatatgactagatatgtcagtgtggcatgtacttaacaaggatgtaagtaaataaatatgcataacgcatgggagtatagtatgggaaagaaggggagtggcgatttatagtacattttgaggctgtattttaaggcaaaaggaagcagatatatagtttgtctaaagttatattttgagattgggagaagggaggaaagaaaacattttgaggttgtaaaatacatttgtagtttattttcaagttatattttgaggctggggagaaagttggaaaggaaaaaaagttttaaaatgcagtttgaagttaagctgtttggttgtaatttttattgtcaaattttattttatttgtatggaaaatggctgccataattgttttggctatttttttgttgagaaggggcatagtttgggggtattagaatggaattgatttatttggatttggaaatatttatgagtatttgggcctatagacaatatttattggagtgttatagtttgaggtttagaaagttttggggaaagtctgtcttacagttttacatagagggtataatagtagtaagttttataacacagggatatatctacccctgtaggccaggccaatgttataagtagtttttgtctctaacatggtcctgacttgaattagaatgtcccctattgatttagtgacaatgtagggtcgcacatagatttaattttttggtgtatattttgtagggctatttgaggcatttttgaattttttaattatgtagggtttttattgttaattgtaattggatgtgatgacacgttggctaatatatatatttaataggctgtaaatagggatatgaatatttatgaaggtggctttaagtcttgtttagtttatgagggtggattagtttagttagttgttttatttagaaggtagtattgtacatgggctaggcctttttatgtgatgaaggcagaaaaaagtttattaagaggcatttttatggaaatagaaaagcaaatattaatgttggaaactatttggatgttaaagtacttttagttatagaggaggaaggcagtagtaatttgacgttttctttgtctgtgttataaggaataagctttagtttgtaaagcctcaggaaagaggtagtagtaattttattgagtttaagttagaaaaataaaagaaaaaaattgaaaatattagtttggaaatttgtactctagaaagaatttaggatttagttaaaattatagaaaataataaaaactcaaaaacagtggataaga

SEQ ID NO: 803 - DNA, 18269 bp, Homo sapiens
agggcggaagccacgggacgtggagcagatggtgaggatagtggggaggtagcagcagaggatgacccgaggcaaaagtgcaagtgaagaaaagtcgccttgccgggcagaggaaattactccaggatttgaatcatcacaagagattcaccagaggattttatacacttgggctgtggcagcagactaattacatcacagcactaggcttgcgtgaggagccatgcagcactcttaccacagacacttggagcaccactggatagacagactggaatgacactgcctcgacccactgtagagccttctcttgcttcaggcaccattcagaagtagcagccttacaagttacttggtgtaaccggatcagagcagagcatccacttgtggtttgtgttgcctacaaaatctaaagaggccgaggactggcacaataatcctgaacttggaaaacaaagactgcataacattacctattgatatagcggccagatgtgactttggttgttttcccttcatatgtggttgtatacaaaatagtacattttgttaagtaggaacttttttggacttgtattatggtaagaaacatgtatgtgtgtcctcctgtaggctgtctgaatatttctttctggtctacatagcatctcttggtctgggcaaacttcccttcccaatttaggtggttctgatgagtaaaggtaaattaccagatagcaaagcaagagggcattctagaaaataagatcagtggaagcaaaggcctatgggcattgtgggttctggaagcagtaattagttcagttgagtagtaagtagcactaggggtgaagagtatgaagagtggagtggtgggagataaaacgggaaatgttaggtagggctatactggaaggagctttatgtaccatatgaagaaagtggacaaaatcctatgctgagggaaaagtagtgattttttttttacaggactgtgatgtgatcacatcacattgatatgaaagatattccatgagggagaatttgagatgagcaatactaggggtagagctattatttaagattacctagtaattctgaataaaatgatgagacatgagctaagtaaggtagtgtgaattagaggagaaaatgaatttaaatgatacataggaagtggaattgacagacttggtggctgactatgtggagtgggaagagagaacaggaatttatgtatgtggttaaaaattatatacttgtatgaaacaatctggtttgagcttgagtggggttcagagagatctgggcctagtgtagagtgaccagctgttctggtttatccaagattaagggatttcgatttcctgggatgtgagacttccaatgctaaaactgtgaaagtccccagcaaaccaggacaaattggtcatgctagcctaatatgaatgggcggacagattagtgacaggagcttatcggcataagcactgaaacaccttctgggataaccatgacctggcaagagagcctttagtggtgcaaagaaatggtgatccttgataatgcatggtagttgctattcaaatctacctcccaatggatccaatctggggtcccacggagaaaggaggctggaagtaaaatacgaaagaactgtttcactaatctgtgaccccgtttaacagagtgtaactcagagaggacagattctttctcaccgtggactaccccacagctctggaaacctgagggctttagtacattgggagattcagttaaatacaggttgggggagttccaagggatggagagggtggggaaagggagaaggaggaactggtaacctgtactggtacaagaaaaactaaaatacttagcagaacagaataacatctgtgcagtggggtataagtcagtgaaatatgagttattacagcacaggtgacatcagcaggcttttcttgaagcaattcctttcagaaggaaagaatgtgttgattactttctttgttatgttgcgccatctactggtaactctcatgtacttttttcctagttagatgtttaaaagaagacagatgaattaaaaacttgagaactgtttccaaagtcgtcatttattcgttcgttcgttcattcattcattcattcattcacttcacaaatactgagtgagtatgtataccttctatattgcagttacatttctaggcattggggttacagctgtgaacaaaactgaaagaaccctgaactcatggaagcttactttgatgaaagagtacatttcatttttttcccatgtgaatgttctgttttcaaagcaccatttactgaaaagattatttttttttctttaggactctgcagtgccgttactgttatatatgaagtgtccatttatatgtgagtcattgcctatcttggttatgctccattgatttatttgtcaatttctgtgacaatatcatattgtctttatcattttactttataatcattgttaatatttagtacatcaagaactcccacctcattttttaaaagaatgttttggatagtcttggcctttaaattttccataaagtttaaaatcagtctgtcaaattctgtcaaaaaaaaaaaaaccctcctgggaatatttattgggattgaactgaatcattaaatcattttagagtgaactgatatttttatactattgagccttccaatcacgatttacttcagttttccttagtgtctttcaatagacataaaagtcttatatatcttttggtacacttatttgtagatacttgatttttttaggctaaaaaggcatctttaaaaaatcatttgctaacaattatggctggtgtttggaaatgtaactacttttgtcatattgattattcatctagggattttgctaaatgctcttataattcaaataaatctctttttcctacatatacaatttatcatttgtagataattataccattaatttgtttttcttatccttcatgtactagttagaagctctagtacaacacagaatagaaatggtgatattaggcaccctttaattgttcctgactttacaggaaaagcttttgacataaaacattacttttctttggttttctacagatactttttattagattaagaactttcattctatttcttttttcttaagtgtttaaaaatcttgaatggatattaagttttatcaaatgctttagaaattttgcatctatgtagaaatactgtaactttttttctgcttgaatctcttaatgtggtgaagaactggtaccaattctactgaaactattcaaaaaatttgaggaggaaggactcctctccaactcattctataaagccagcatcaccctgataccaaaatctggcaaagacataatgataaaagaaagctacaggccaatatctctgatgaatgtatgtgcaaaaatcctcaacaaaatactagcaaactgaatccgaagcacattaaaaagttaattcatcatgatcaagttggtttcattcctgggatgcaaggttggttcaacatacacaaatcaataaatgtgattcaccacataaacagaattaaaaacaaaaaccatatgatcatctcaatagacacagaaaaagctttttataaaattcaacatcccatcatgataaaagccctctaaaaaatagtcaccaaaggaacatacctcaaaataagagccatctatgataaaccagctaacatcatactgaaggggcaaaaattggaagcattcccctggagaattggaacaagacaagaatgcccactctcaccactcctattcaacatggtaatgaaagtccttgacacagcaatcaggtgaaagaaagaaataaaagacatccaaataggaaaagaagaagatagtttgacttcttctttgctgatgataggaatctatacatagaaaaccctaaaaactgccaaaagtctcctagaactgataaacaacttcagcaaaatttccagatacaaaatcaatatacaaaaatcagtaacatttctatacaccaataacattcaagctgagagccaaaccaagaatgcaatcccatttacaatagctgcaaaaaacaaacaaacaaaaacctaggaatacaagtaatgatggaggtgaaagatctctccacgaactacaaaatactgctgaaaaaaaccatacgtggtacaaacaaatggaaaaacagtccatgctcatggattagaagaatcaatattgttaaaatggctaaaagcaatctacagattgaatgctattcttatcaagctaccaacattattttccacagaagtagaaaaaactattctaaaattcatatggaaccaaaaaagagtacagatagccaaagcaatcctaagcaaaaagaacaaagctggaggcatcacattagcaacttcaaactatactacaaggctacagtatcaaaacaacatggtactgggacaaaaacagatgcacagaccaatggaacagaatagagaacccagaagtaaagccacacatctacaaccacctgatctttaacaaagtcatcaaaaataaacaatggggaaaggactctctattcaataaatggtgctgggataactggctagccatatgcagaagactgaaactggacccctacctttcaccaaatacaaaagttaactcaagatgaattaaatatttaaatgtaagacctcaaactataagaatcatagaagaaaacctaagaaacctattctggacatcagccttgggaaataattcataactgagtcctcaaaagcaattgcaacggaaacaaattgaccagtggtacctaattaaagtaacaagcttccaattaaagctaccaattaaagtaactatcaacagagtaaacagcctacagaataggagaaaatgtttgcaaactatgcatctgacaaaagtctgatatctagagctataaggaacctaaacaaatcagcaagcaaaaaaccaataaccccatttaaaaaatgagcaaaagacatgaacagacacttcccaaaagaagacctgcaagtgggcaacaaatacatgaaaaaatgctccacatcgctaattgtcagagaaatgcaaatcaaaaccataatgagataccatctcatatcagttagaatggctattattattattattttatttttattatattttagatggaatctcgctctgttgccaggctggagtgcagtggcacaacctcagctcactgcaacctctgcctcctgggttcaagtgattctcctgcctcagccaccatgcccacctaatttttgtatttttagtagagatggggtttcaccatgttggccaggatgtctccatctcttgacctcgtgatccacacgcctcagcctctcgaagtgctgggattacagttgtgagccactgcgccgggctggctattattaaaaaataaaaataaatagatgctggtaagcctgcagagaaaagggaaacttatacacttttggtgggaatgtaaattagttcagctactgtggaaagctgttttttgagttgtgtgagttctttacatattctacatacctaactcatcaggtaaattatttgcaaaagttttctcccattttatgggttgtctttccactttgttgttagtattctttgatacactaaagttttgtattttgatgaattctaatttatttttttcttttgattgtgcttttggtgtcatatctaagaaaccattcccagctgtgcatggtagtgtgcgcctgttgtcccagttacttgggaggctgaggcgggaggatcccttgagcccaggagtttgaggttttaatactgtactgtagtgaaacagtgtattatagtgaaacagcatagtgaaactttgtctctaaaaaaaaaaaattctttttaaagaaataaatctttgctaaatccaagataatcatttattcctatattttcttctaagagtttcatagttttagctcttatgtttagattttttatccattgtgagttaacttttgtaaatggtctgaggtaagggcctagcgttattttgtgggacagttttcttcttgtgtcatttgtaattttatatttttctaaaataatttctatttcatccatatattcaaatttattaaagttgcttataatatgctttgttagcttttaaatatctgtattattggtaagagtagctccccctttttatatgatactgttacttgtgctttctttttttcttgtctaattttgccagtggtttgtcaattttattagtctttttaaatagaaaccactactagcaaagaaatagaacattgtcagtctttcttcttttctgagcactgatgatgctctagaccttggcctagatagttgggttttatttgtttgtttgagacagggtttcactttatcgcccaggctagagtgcagtgagtgcacaatattacctcactgtagtcttgacctcctgggctcaagtgattctcccacctcagcctcctgagtagctgggactacagatgtgcaccaccactctcagctaatttttacatttttttgtagaaacaaggtcccactatgttacccaggctggtctcaaacttctggactcaaatgatcctcctgcctcagcctcccaaagtgctggaattacaggtgtgagccactattcccagccataactcgtttttgctacatattactcaactacatattactcaactaatgtttttgctaaacattactcattcattcaatacatattttgagcacctactatgtattgaggatacatcagtgaacagacaggaaattctgttctcatgaagcttacattctggtcggggagatagataataaataaaataagtaaattacataatattttagtaccttagaagggattaagggctgtgaagaaaaataactggagaaatggataaggagggaacagactactggaatttttaaaaaaatggtagacatgtaagacctcattgagggtacatattttttaaaaattagtttgaaataattatgtgtttatgggaagttacaaagatgattcagagagttctattagccttcactagttacccctaatagttgcattcttgtgtaactatagtacagtataaaaaccaagaaagtagcattagtataatgtgtgcttatagtagtatgccattttatcacacatatagattcttgtaccaataccacagtcaagatactgaactaggctggtagcagtggctcacacttgtaatcccagcactttgggaggctgagacgggtgggatcacttgaggccaggagttcaagaccagcctggccaacatggtaaaaccccgtctctactaaaaatacaaaaattagccaggtgtggtggtgtgcgcctgtagttgcagctagttgggaggctgaggcatgagaattgcttgaacccgggaggcggaggttgtagtgagccaagatcgtgccactgcactccagcctgggtgacggagccacactctgttaaaaaaaaaaagatgcagaactattctgtcctcacaaagatattccttatgctatgttataacacaaagatgtctttatagttcaccttactcccctcacttctaccatcactaacccctggcaaccattcatctgttctccacctctctaattttgtcatttcaaaagcattatatagatggaatcatacagtatataaccttttgaaacgatatttttttcactcagcacaatgcctttttggtctatctgagttcctttctttgtgtattccatgatgttagtataccacagtttgtttaaccattcacccattgaaggacattttggttgttttcagtttctggctattacaaataaagctgccatgagcattggtgtgcagggttttatgtagatataagatttctttaggataaatactaaaagtgcaattcttgggttgcatggttgtatatatttagttttttaagaaactgccaaaatacttttcagagtggttataccattttatcagtaatggtgggatgagaaacgttgtttctctgcatcttgccagaacatggtattgttataattttttattaatattttagctcttctaatagcacctggctaatctgaatttatatcagaaatgaaagcttaattttgattaataaaaccaatcgatataattcactttattaagaaatactggaaaaagttatttgatcatctccgtggacacacagtttgatgaaatttaccaaatattcatgataaaaattcttagcatactagaataaaagaaaatttcctgccaactaggtcaggacaaaaatgaaaaaaaaaaaaaaaaagaaaaaagaaaatttccttggtacaatgaaaggtatgtacaatgtaatacctagagcaaccacttaaaaaaatctatatgaagagatacactcgaaaacactatcaataaatcaaaatggaattctgaaaaatgttcaagtaatccacagaaaggcaagaaaagagaaacagaggaaacaaaaaaacaaagggaacaaacagaaaagaaaaaataaaatgtcagacctacgccctaacatatcagtattaataatcagtgagctctggactctcttctttatcccctttgccgctcaaggttttcaaaagcaccactcattctcttaaaggacttttattaaataggcagatgaccccaggggaaaggtcatctcaaatgccgggctaaccctcctgagcctctgtctttctggctcagtaattaccctcctggctaagtaattccaaagagttatggtagatttctgatgtcacaaagaaaatttttaaaaaatacttttttcagctttgttttagggcctcagccttagattgtatttcctagtgcagttttttaaaaaaaaaatcggtgacctctctcatctaatgctttctctgttcttgtagatgctttactttttccctgtcattttgatgagatttggggcaagaccatggaaaaggatgtaaagatggcacaggctcattattccctgagcttctatcctctaagatcctaggctgggaattctacgtaatcttgttagctctgtgatgtcctcaattggtaaaagagttggatcttatttcctagactagagattgacaaattatggcctgtggtctgcctatttttgcatgacccatgagctaataattttttgctttacatttcttaaacttgtttttgaatagttttagatttacaaaaatttgtgaaaatagtagagttcccatatgacccacaccctatttcccctattattaacatcttacattagtatagtacatttgtcacaattaatgagccaatattgatgcatattattgactcaagtctacacttttgatttccttagtttttatctaatgtcctttttctgttccaggctcccaaccaagattcctcactatgtttactaatcaaatctcttgagactcctcttggctttgacaatttctcaaactttccttgtttatgatgactttgacagtttgaggagtgttaataactgcaaagtttcgagggcctacagaatgtctctcagttgggatttgtctgatgtgtttatcaagaacacactaaagttatgggtttttgggtggaagaccacaaagataaattgcctataatagactcatgagactgtcataacaaagtaccacaaattatgtgactttcaaatagcagaaatttattctttctcacagttctggaggccagaagtctaaaagtgttaaccgggttggtttcttctgacagctgtgaggaagaatctattccacacctctctccttagcttctggcgatgactgtcaatttttggtgttccttggcttataaatacatcattctgatttctgcctctgtcttcacctagctatcctctctgtgtgtctgtcaaaatttccctcttcttataaaacacataagtcatattggattaaggcccaccttgatgacctcaccttaactaattgtaactgcaaagactatttgcaaataaggttccattcataaggtttggggtagacaaaacttgagaacagagactcattttcttctaaaatgctttctctgaaagatttttaaaaagaaaagggtggaaatttgaaagaaaaataagtctcaggaccccaaaatcagtaagccaaagggaaaagtcaagctgggaactgtgttaggcaaacttgcctcccattttattcccaaataagatagccacaaagatttaaaaaaaaaaaaaaaagctacacacctccctcacaatttatccacaaggaaatttcttgtgggcctcaagatctttaccctaaaacagttctgttgaatttcaccctggcaaagtaaattggtagcttatcttcacaggtgcaggtcaaagacagaactcaaaagtgatccctctgctcacctgagacaaacgcacacctgattgcttgctctgccctgttgtttatgtaaaaatgtagattcgctaagccagactaaggcataagagattattcctctaccctcctctcacatgtaaattgtgtattcagtgaaaggctaatcaggctcaaaagaattagccttttctctcttatctacctatgacctgaaagtcgtcctccttcctacctgtttgagttgtcatgccttttcagaccgaaccaatgtacatcttgcacgtattgattaatgtctcatgtctccctaaaatgtataaaactaagctgtgccccaactaccttggacacatgtcgacaggacctcctgaggcggtgtcgcaggtgcatccttaatcttgggaaaataaactttctaaattgggggaaaaaaagaacttcagcacatcttttttgggggacacaatttaactcataacagtgccattctcatcacatcgtatgaaggacacgagttatcaacatggcttatcactgttgatgttaaccttaataacttggctatggtagtttttgtcaagtttctccacggtaaagttactctcttcctccctgcttctaaattattctctttggacagaagtcattatgttcagcccacacttactaagccagaaggatgggaaattattctctacctccttgagggcagagtattcacatcaattatttggaattcttttgcaatcattcatttattcatatctgtgtggactcatggatgtttgttttatattttgggttagaattcagttctacattatttattttgttgctcaaattgttccattggaagctcttttagttggcttctttttgcctttgacatactcttttcattgtgttctttttgggcacttccttgcttctgggactagaatatactccaggatcatcttgggatcatcggcatgggtagggaaaatgtacagaaatggtatgagaatgtgtcccctttttgtacatattccatacccatcctctggaatcagccatttcttcaaggagctctgattccttttattggagaatggtattaaaaaccaaaattttggttctaggtctatttgttgctactggagtgtcattgtttctaagccccactcagctgacagaacaaggaaatatatgtttctactaacctgtgtatacacacatatgtttataaacatttctacatgtattcatttgtatcgatattaagctaaacatgagttcatattgatgtctccaactctcatgcattaccacatggatcattccggccccctcctctggtttgtctgtaatctcacattccaacagtaagaaacatggcccccaccatccaccatccatttacttaactgttcaattccagtatgtccatgtatggtggtttcagaattattaacctgtacccccatggaaacaacaatttgaccaactagagtccagcacttatgtacagttcctttttagtcttacagtctccactcatttccaaagttaggtcaggatgttttcctcacaaactcttcagtgagatcatttcatgcatttgtaatacatttagattattttttgtcacactctatattctgtcctgtgatctccttaccccctatatgatttttcaaaaatttgcatacattaagatgtggttggtgctgtaaagttctatgggctttgacataagcatagtgacatgtatcaaccattacagaatcatacagaatagtttcactatcctgaaaaatcccatgggcttcacttatttagccctcccttccccaaggtcctggcaatcactgatctgtttaccatctctatagttttgccttttccaaaatgtcatgtaaattgaatcatacataatctgtgatagtcaattttatgtataaacttgaatgagttaagggatgcccaggtagctgctaaaacattatttctgtctatgaaggtgtttgtggaagagattagcatttgggtcagtgagactgagtaaagaagatctgctctcaccaatgtgagtgggcatcatccaatttattgagtgtctgagtagatccaaagggtagggagagggtgaatttgctccctctttcagctgggccatccatcttctcctgccctcagacgttggccctccaggtgctcaggacttagtgtttgaactgaattacaccaccagctttcttggttctccagcttgcagatggcagagtgtgggacttctcagactcaacagtgtgagccaattcctataataaattttctctttctttctgtgttatcactacacacacacacacacacacacacgctacagtcattctcagtatccatgagggatttgtttggggacccctgtagataccaacatctgtggatattcaagttccttatataaaatggcatagtatttgcatgtaacctacacacaacctgctgtatactttaaatcatctctaggttacttataatacctaacacaactacataaatagttgttaggttgtatgctttaggaaataatgaccggaagaaaaagtctacttattcaggataatttttttttctgagtattcttgacccttggcaggttgaatctgcagatttggaacctggggatatggaaggctgactgtatatatgtgtctccatcctattgactctgtttcattggggcaccctgactaatacagtgcatagttcctcacctacttttgaagctgtggttgcaatggcaatataggtttcagagcctatacagagctattcgagtcttctttgttcactttgttcactgaagctcccacttgattctgctgatgcttcctgcaggggtgagtgcactttctcaggcctggttccactaggtgaagtgtgggagatgccaggccatgggtcagtgagtgcttccctgaacctgacctctgggctggctagtgccagtggggctcttgtttgatccctgctggtgttacctgagggcgtggaaggtgctttcctgccctccttagtgccagcttatgggtggaggatgctggggctatggatagacaataattctcagggcctgctcatcaggtcacttggtgctgatgagcttccttactgcatctctgctactgctgctgaggtgggaaacatctacctgggtgccttctgccaccgatgttggagggagagtgtcaggaaacagtgggcttgggttactctgggtcaggaatcagcatggcttggctagatcttctgcttctgtgtttctcacgaagctgtaatcaagatgttggctgccagtaaggtctcatctgaatattcaacgggagaaagatctactttcaagtgccctgatgtggttgtcagatgtattcaattccttaagggttcttggactaagagcctcagttcctttctggctgttggctagaggctgctctcagttacttgctgaaggagtccaacatggcaacttgctgcacccaaagcagcaagcaagcaagtccagtagcaagacagaagtcacaatcttatgtaacctaaccatgaaaatgacatctcattacctctgtcatattcttttggttgaaagcaagtcactacattcagctcacactcaaggttagggcgtgggggaagtagattacataaggacatgaataccagaagtggatcattaaggaccatagtagagtctgtctgccacagtcatcatcaatattccttacaattttagggttttaatggccaataattcttatcattgtagaatacttagtaaacctcagttttttcaattttttctctcattaaaggggattaaaatataactgtgactttagaacctccagttcttataacatttctttctttccctttctttttctttctttctttctctctctctccctttctttctttctttctttctttctttctttctttctttctttctttctttctttctttctttctttctctccccctccctccctcctctgtctctccctctatctatctatctatctatctatctatctatctatctctctctctctctctctctctctctctctctctctctttctcccctttctctcctttctctctctgtcacccaggctggaatgcattggcataatctcggctcactgcaacctccatctcccaggttcaagttattctcctgcctcagcctcctgaagtagctgggactacaggcgcacaccaccacactgggctaatttttgtatttttagtagagaagggatttcaccatgttggtcaggttggtctcgaactcctgatctcaagtgatctgcccaccttagcctcccaaagtgctgcgattacaggcacgagctttttttctttttttgagacagggtctccctctgtcacccaggctggagtgcaatagcatgatcacagcacactgcagcctcaatctcctgggcttaagcaatccttccacttcagcctcctgaatagcaaggactacaggtgcatgccaccacacctagctactttttttgtttgttttttgtagagatggggatctcactatgttgccccagcttgtctccaactcctgggctcaagtgatcctcccatctcagcctcccaaagtgctgggattacaggcacgagccaccatgcctaaccttcttataactatgctatgatgcctcactaaatttatgaaaacataattagtatgattacatattcttatagaggcaagttcttcctttcctgagccatcatagcattttagttatgtcttccttgtgattttgagcacttttaaacttgcaaaaggaatatttgtgaatagtcttctctcccttgctagactgtagggtctttgaggataaattattattattacttgagacagggtctcactctgtcactcaggctggagtgcagtggcttgaataaggcttactgcagccttgacctcctgggctcaagcagttatcttacctcagcctcctgagtagctgggaccacaagtgcatgccaccatgaccagctaattgttgtatattttgtagagatggggtatcaccatgttgcccaggctggtctccaactcctgggctcaggtgatctgcccacctcagcctcccaaagtactaggattgcaggcgtgagccatcacactcggtctgacaaattatggtttttaacattttttacacctgactgcacccaaaagagtacatttactatggagttcagtaaatatctattttaaaaaaaaagtcccatagcatttttaaaaatatgaactcaacatctctttgtatcaataaaagtgagatatagatttgatttatgtatctctagttcacctaagttcactcagatagtagacagactgaatactaattgaggagattaatcacaagcagttcatatccaaacactgaaaaatgtagtaaatatctgatgaatgagttgatgaatattcatttttctccatatatatatatatatatatatccctttgacatagtctctgtgcatgtttttgtgcatgaatgtatgtgtatgtgtttgtgtatatatagacacatgtatatatacacacatacgtatatatacatatatgtttatatatgtatatatgtgttttatatatacatgtgtatgtgtatacatatatatgcacacgtatatactcatatgtatatacacacacatatatatgtttctgagctagagtctgggtatgtttcttcataagaaaattttatgcctccaaagtatttccacattatttataataatatataataacatcacattgtgtaagtaataacattagtttatcatccatttattctttatccagcataggtagaattagatgattcaaaattgcaaagagaaacataatttattttggaagattgtacatttttgtaagtttctaaaaagctaaaaactttcatgaattttgtacttgagaaattactgtgattcctttgttaattcataaacctaatggtataaccatcacctttctgactgccatgctatcttaacatttttaatttggggaggggttctaaactttgtatcccaattatattctggtgataacagcttagtaggtttattgacaaaaaaatatttgtttaggtagctttcatataggctgttaagtttatttgtggtgtcctgaacagttcctttctgctattctttttttttaaattttattattattatactttaagttttagggtacatgtgcacaatgtgcaggttagttacatatgtatacatgtgccatgctggtgtgctgcatccattaactcgtcatttagcattaggtatatctcctaatgctatccctccccactccccccaccccacaacagtccccagagtgtgatgttccccttcctgtgttcatgtgttctcattgttcaattcccacctatgagtaagaacatgcggtgtttggttttttgtccttgcgatagtttactgagaatgatgatttccaatttcatccatgtccctacaaaggacatgaactcatcatttcttatggctgcatagtattccttggtgtatatgtgccacattttcttaatctggtctgtcattgttagacatttgggttggttccaagtctttgctattgtgaatagtgccgcaataaacatacgagtgcatgtgtctttatagcagcatgatttatagtactttgggtatatacccagtaatgggatggctgggtcaaatggtatttctagttctagatccctgaggaatcgccacactggcttccacaatggttgaaccagtttacagtcccaccaacagtgtaaaagtgttcctatttctccacatcttcccagcacccgttgtttcctgacttttttaatgattgccattctaaccggtgtgagatggtatctcattgtggttttgatttgcatttctctgatggccagtgatggtgagcattttttcatgtgttttttggctgcataaatgtcttcttttgtgaagtgtctgttcatgtcctttgcccactttttgatggggttgtttgtttttttcttgtaaatttgtttgagttcattgtagattctggatattagccgtttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttctgctaggctttttatggttttaggtctaacgtttaagtctttaatccatcttgaattaatttttgtataaggtgtaaggaatggatccagtttcagctttctacatatggctagccagttttcccagcaccatttattaaatagggaatcctttccccattgcttgtttttctcaggtttgtcaaagatgtcagatagttgtaaatatgcggcgttatttctgagggctctgttctgttccattgatctatatctctgttttggtaccagtaccatgctgttttggttactgtagccttgtagtatagtttgaagtcgggtagtgtgatgcctccagctttgttcttttggcttaggattgacttggtgatgcgggctcttttttggttccata

SEQ ID NO: 804 - DNA, 7664 bp, Homo sapiens
gaaagagcgtagattcaaatataaacttacctaatgatacgctcaaactgttccttccattttgggaccagggaacagagctcacttaatgctgctctcccactgatgatgcccacccattctcggcctgcaagccctaccactcacagcttcaaaaatggctccgcccttcctgattccaccccacacagaagaaagcaacttcttgtgatgcttccttattctggatgtggctcacctcttaccccttccaactcctttgggtcccctagaaagcctccctggctaaggggtacaggccctctcctcagcagtgggcactgaccgtctaaccagggctctgtctcggcacctggtagcaaggacggcaagatacaacaacatgctgattttaatagcctctggctttctccactgcgtttctcacctgaatgccctgcacaccaaatcttccatggggtcacccttgacctctagggcaattcccaagaatctagcagaggagtgggggaaaccaaaaggctgacatgaaggactcaagggaagcctctggaaagaagagaccagacactaaaagggatgtgtgtgaaatactggtttttattggttggcacaagattacaacctacaatttcaatgcccttccctcccacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtagggaaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaggtgtgaaggaagcctgaggacatccacctcgagaaaaggaaacaggaaaactatttccttccgccttctctggaccaaatttcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgttttataacccgcacaaggtgccaagaggtttaaggaccacaactgacctctctttccctacaagcaccattccttggattcccagttttgttgagctcatttgaggtcatccttgccatcctcttaaaaaatgacacagcctcttggttattccattttctatccctttctacaattatgaacacactctctaaacaggagatctatatatgctctcatcctgcaacccaagagattaggtgacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggagcaaattggatttttgaagggagagtcctcttagaaaattctgagcaaacatgctcccagtcacgagggatggggtgagcgggcaggtttctgtctgtgagctatagctcccttctgaactccctcatgttcttgggaggacacaagcctcttgctcattaagcaaaggccctccaagtctcctttttacttcagcactttggaaactctccaagacttaacttccgatctggggaggttctacgtggagcagacctatcccttcttattcctgttcctgggtgtctccataatcagcctctaccttccctggcataagtcatatctgttatgctgcaggaactgagtaaccaaagctagatatcccttggaccactgattagtgacacattttctccacaacaaagggaggttaaagacaaaggtttaacctgagaaactttttttttggcaagataataaagaggttaaagaggctacgtggatctgtcactgctttagcttaccattttcaattcagcaccaaagtgctcagaaagacaggctcagatcaggacgacttcttaaagggattcacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtagtcacagataataagcaatttagtagataattattctatacaagaattaatgttctctgaaacagtgattaatagaatcttcacatctggcctggctgggaggcttgggggcaggaaagggagggtggaaggatgggtagcacatcaaaatggtgatgaacctggcaaaacgacaatgctgctgtttttgtatcctttaaagcctatatccagggttttaaatgacgctttttttgtgtgcttcctgataggaagtcaaataagttttagtattaagaactggggatataaaccaaaggaaacctagagtcaactgactgctggaggaacagaagcaatgacttctttccaccttctagatagtaatcttacttttgttggctaaaagcactttcttcagcattctgagttaacacgggttccctataagctcccctccccaggtggacagtcttattttctaagacaagctcaaagctcaaactcaccaaattaccactataaacaaagcttcagggaagagacataaccttacttcaaaagcttcaggtcagagacagccaaaatcatgtgactgctagcctcagctcaagtagtgtgcccaaatcatcacaaaatgggattcccttcccttttcttttttttttttttttttttgagacggagtcttgctctgtcgcctaggctgcagtgcagtggcgggatctcggctcactgcaacatccacctcctgggttcaagcgattctcctgcctcagcctcccgagtagctgggactacaggagcgtgccactacacctggctaatttttgtatttttagtagagatggggtttcaccatattggtcaggctggtcttgaactcctgaccttgtgatccacccgcctcggcctcccaaagtgctgggattacaggcgtgagccaccatgaccagccctccatttattaatttataaggggactagaaggacaaactatttgattaatttgaaggtgagaggtatcattttctcagatgctccaactaggcttctcacatccctcaaaggttatcagctaaagacaagagtttctgaggctaatgcaaaaacatggtcaaatgtgaaaccgcccttttagaggcagggtttgtgaaaggctgctggcctccaaaggagagtatgcctaaactctctgggctcccaggacctgtggtgacctcaagctaacctgatgcacagacaacagtatcttttagggactgcagccaatgttccccaatttactttttttttataccttaaaatatcaaatgtttcatttttaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaag

SEQ ID NO: 805 - DNA, 3444 bp, Homo sapiens
gtggcagtgcctttgagggagctcttgcagagggcagccttttgaggtgaagagccagagctctgggtcttaagagttggaaagcaggttatatttcacatccttccctgaatagagaaattgaatttggtcaagaataagtcctaagaagcagttgtgagcaccccacctgtccatcttgttgatgaatatggagtgggagaaaagttgagtgtgggcatctgacaaggtctttatgatcctagatgcacttactataccttcttcctcctcctctgccttggctaatgggttgtgggtacccaccgcacagagggctataagacagtccttgtggctgatgcagaagctgggccctgccctcctggccttctgaggaaagtgattatcgtttttggcttgtttttcaactatccctttgcccccagcaggactgaacctttccactcttaccatctctgggtcccttcagatcttttatagccttgaactacctgctacaagatttttttctgtcctaagaatggaggtccggtctgcttcctaacattaatcccttccacacggcacagccttgttttctctagatcagagagatggcttctggattcatctttccctgcaatccagcttctcctcctggggccctcatactggagactgggatcatcatccaggcttttgcactgggccaggaatttgggagtcatcctggatccgtctgcccctgtcaacctttcgctgtcaacggatatttattgggcgtcctcaacagccaggccctgttcatggtactgaagaacagcttgtataaaacaaccctgccctcacagggcgatcaccagtgacctgtggtgtggagtctccttttacctatgtctcctccttcccactgtcaccatccttggtcctcctctgtcacctggaatactccacttggtaaccagcatgatcttataacgctagttttacccttgtcagcactttgccaaaaacctcaaataaagactttttttaaaatgtgcaatggaaaaataaagttataaattatatcataaccagtggacctctttttaaaatgcactgaagccttataatgttattcatggatatatatctatggtaaaaatagaaaaaatatatgatggtggtgcctctgaaagggaggggaatggtactggggaagggacaaagggaacttcaactttatctgtaatgacctgtttattttgaaactcaagagcaaaattgacaaaattttaacagtaacttaacaaaacctcaagtctggatagtgggttcaagagtgttactttatatggacaggcagtgactcatgcctataatcccagcactttcagaagccaaggcaggaggatctcttgagcccagccatcctcccgccttggtctcttgaagtttgagactagcctgggcagcatagtgagaccctgtctctacaaaaaaaaaaattaacagcaactcaggaggctgaggcagaaggattgcttgagtacgggaggtcaaggctgcagtgagctatgactgagccacttcactccaacctggatgataaagcaagactctgtctcaaaaaaaaaaaaaagtgttgcctgtaatcccagcactttgggaggctgaggcaggtggatcacctgagctcaggagttcgagaccagcctggccaacatggcgaaaccctgtctctaccaaaaatacaaaacattagccagatgtggtgggatcagtctgtagtcccagctactcaggaggctaaggcaggagaatcacttgaacccaggaagtgcaggttgcagtgagccaagatctcaccactgcactctagcctgggtgacagagtgagactccgtctcaaaaaaaaaaaaaaaaaaaaaaaaaaggagtgttacattagttgtctgtattgtagatacacttgtcaaaatttaagccataaaaccctcagtgtccctcactcttcccacccccttagcctggcctggcatactgggtctttcacaagcttgtgtcaacctcctctacagactcatctctacactgagggacttgcagtttccaagtgctctggccttggggcctttgcccatgctgttctcttctgaatgccctttcctgctttgctactttgttcttgcccttctggattcagctcctgggaggccctgtggatagaagtcagatggctcaagtaggcagctggttaggacccaggagacagaaacgtgtctggggaggacaacactttcttgtcctggtttctattcagctgcaactagagaaacagatcacctgtttcttgttcaaaactaggatcagtgagaggagggtggaaagagtaagatcctccacagtaccctcccacctcccagcctccccccacatagactagccccaaggcagaaacttcccagcagaaaaaggaaaactgataacctcattccttggtctggctctgttaggattatcatctggtttcccctgctggtgttggaagagctgtgttggtgcaggccagtgctatcctgtgactagagggaagaagctctgcctgggcctgatttggccacaagctcctagtaagatgctgaaaaggaacacaaactctaggcccaggacgccctccccatgccatcccacacctgacttctgcgcaccttgtgagcagatcagatttggtgttgcttcttccacatcatcctcgcatcccctttcacagactcggatatatcccctcatgggaacctatggatctacagcatatctatggatatgccaccccatggcaactgtcctttccccttcatagcatacatcaccctgaattatagctgcctgtttatgtatgtgtcttctgcaccaggtggtactccctgatggggcagggattgggtctgtcttgttcacagttgcatctccagcacctgcaactctgcctggctcagagtaagtgctcagtactttttgtttttgattgaatgatagaatgacgagtgaactctatttcccactagactgtgagcaccatgttgacagggaccatgccctgatcatctctggatccttagggcctatatagtgcttgccacataggaggtgctcagtagacacttatcgatttgagtgaatggacttcagtttctccacttacaatctgagtaagaggaagatattctttgtcctctctccctccttctccaaccacattgggggttgtggttgatgctgtgaggtcattcctgccttattcaacttcatgtccaaatcttctaatggcaaaacacaacatggtggccaagtctcagagtccaggcatccctcccatagcccatagccaagtatgggagaagggtgcttcagggtctctctccattcactttagtctccagcattagccaagatcccactgtctaccctgaattcttc

SEQ ID NO: 806 - DNA, 2635 bp, Homo sapiens
caccaaaggatgaggatgaagaagtgactctgatgagcttgcagcaagccctagcagggcaagccccagccccaaggatctgcaccccgcacccggtgggcccagcgtgggagaggccgggagcagcagtgggtacctgtgcccaggaaaagcacctcatagcgcccgtcggctgcatccacctggtccacggcaatagtgccagagcaccctgcctgcctgctgggcactcacggagctcatcaaagtgagtctcaatgccatcctcgcccgggacagagcagacgagccgcgccttcaggaatgtgctccacttgttgaccaggcaacagtgaccaccgtcatcgttctggggggtggggcaagaggccgggtcagatcagctcttgaccccaagccctggctggagcagggctgatgaagccagaactggtggaaggggcagcctggtggctctgccaatgcataccaggcaaatgcgcccgatgcgggcgtacaccgcggggctctgcggcgcctctgccgaccgctcacggaagaagaagtaaagcttatcatcattgcgctccgcactgtcaggaatgagctcagcatggatgaacgacgggtctgcaggtggcaggggtcagctgggtgagcccctactctgatggtgcccctgatgttctccaacagaatccccagccaggtgcaagaacacccccaactcctctccagataagaaactacccctgccccaggtagtcataggctaaacatgtccccacttcccccacatgtgcttctttacgacctccttgccgcatcccagacacatggccacggaagggctcctggggctgcgcttaccgttcagccaccgggagttgtactgatccgtgcgcatggctgtctgctttccaagtgtgcggaagatggctgcatcagtgcccataaaatcgatgtacacaccagcatagagctcctcatctgtgggtaggccagtgggtcagttggggggctgctgtttgctagggccagggcacagctcagatgacttccagggcagggccttatctccccgctcaggctccctggggcatgatcctatctccagtggagtgctggtcagtgtttcaccactggctctgggagggttgggattagtaactatcagctctgattagtagcaatagcccatttctgtggtgtgaatactcctgccacaactaatttcaagctaccaacctgaggtcactgaaagcaaaatcaggaagagctgccaacaccactgtacagtatttctaccccacagacacaacaaatgtaaatcacctcaagagcatagctaatagaccagctgcagtggctcatgcctataatcccagcactttgggaggcccaggtgggtggatcatttgagggcaggagctggaagccagcctggccaagatggtgaaaccctacctatactaaaatacagaaattttctgggcatggtggcaggtgcctgtaatcccagctacacgggaggctgaggcaggagaattgcttgaaccagggaggcggaggttgcagtgagcgagatcatgccactgcactccagcctgggcaacagagcaaggctccatcttaaaaaaaaaaaaagaggccgggcatggtggcttatgcctcctgtaatcccagcactttgggaggccaaggctggcagatcatgaggtcaagagatcgagaccatcctggccaatgtggtgaaaccctgtttctactaaaaatacaaaaaaattagctgagcgtggtggtgcacgcatgtagtcccagctactcaggaggctgaggcaggaagatcccttaaacctgggaggcggaagttgtagtgagccgagatcgcaccactgcactccagcctggtgacacagtgagacaaccgtctcaaaaagcaggaacaaaaataaaaaaaaaaaacacaaaaaaacaaaaaaagagcatagctaacaataaagtgtagtgaaagaattaggaagcatatgcacacctcagtttactgggctttgtgcactgcaaatactgcattttttacagaaggaaggtttgtggcaaccctgtgtcaagcaagtctgttagcaccattttttcaacagcatatgcttactttgtgtctctgtgtctgtgtcacagtttggtaattcttctttttttttttttttgagatggagtcttgctctgtcacccaggctagagtgcagtggcaccatctcagctcactacaacctccacctcccaggctcaagcaactctcttgcctcagcctcccaagtagctgggactacaggtgcccaccactacatctggctaatttttgtatttttagtagagacggggtttcaccatgttggccaggctggtctcgaactcctgacctcaggtgatccacctgcctcggcctcccaaagggctgggattacaggcatgagccaccgcgccttgcctacattttggtgattcttgcaatatttcaaactgtctgttatggtgatctgtgatcagtgatctttgatgttactattgcaattatttcggggcaccgtgaacctcacccatataaaacagtgaacttaatcgataaatgctgtgtgtgttctgactgctccactta

SEQ ID NO: 807 - DNA, 6945 bp, Homo sapiens
agccccagcgctggctgcggcggaacccacggcgtaccttcccgcctccaacaaactatccggttgctgaggttgatttagcaacaccccagggcatctgggttggcaggagcaccacagtgacagcctggcccaggctcgggtacgggaggcagcccagtggcccgcagtagagggccaggctggggaccagggagctggggctgaggagaatttgtacagcctagggaggcgcagcacagcagtatcagcctctggcatttgtaccacctttagtcctgccactttctctcactgtggcttcgcaacagacttgggaaccaagaaaggcataggtgaggaagctgaagcccagtctgggctcgcggaagaaactggtggatccaacttctgcatagcgcaaatatctgcttcctgcctccacccacccattcccacttccgtgagtatattcatccatccaacacttattattactccttgccaggacagttctaggggctggggatagagtgaacaaaaccaaggttctgccctcctggagttcacgttccatgggaatgcccttcttccaggctcctccctcagtgcccaggttgtggctgtgggaggctggtctacctttgtggtttagcggtaacttacgtgattcccacgtcaagtgtaagctccttgatgattggttcaatcttcacctcaaatttctgaggacctacaaactacaaagcactcttctaggggcccaaagataaaacgctcccctcgtgaaaatcccggacttttggtgggaggtggggaaggtgacaactatgctcataagcttggctacaagaccggcgaggccaagagctactttggtatcctgacaaggactgatgtttgggagggggatccagcagatgggaacaccacgaaggtggtggtgggaaaagtcagcagtcacagggtggttcaccttgtggatcccactactgcaccagcaaagagcaggctgggcacacagagacagtcaaaatcccagcttcctttccctctgcttcacattcttccttccgcaggcaggggagtttgaaccttatccacagggccaagcctgtcccagccctctaggcaaactggcagaacaggcagctggcccctcacaggcactccgggctgggccagtgcaggtcgcagcagttgttttacctatgaacatcaagcacatggtcaaaccctcagcttaggtgccccaggcaggcgggctacacacttggtagcatttcctttgacacaaggagcagccatggcccgggctcagagactgacagcctctgcctgcagggtctgcgtggtcatttctcctgcttctcagaaggtggtgagcttttcccaggaaaccattataaggaagtgcccattctttatcttgttctctctgctcacttcccttagcctgattggggaactctagagccccacatcagagttcaacatgtgcctcaggagcttcagcacctcttttgtgggaggagagtccgctggtgactggggctgcaggccatgacatcagcctgcccagcttcacctcaggctgcttccaacagtgccaagtgaggtcccttggcaggatccctgcaaggcagcggctggccaccaggaggcagcagcctactctacaaggcactttcttcattccaaccccttgtaacaggtctgaggaaacctgttcgcccagccatgtgctgcaaccatcctccactcccaatcttatctcccaatagcacagattcccctatcatgagtccagacttggccttcatctcctcttgccttcctctgtccaaggaatcactacagagattctttctctatccttctttgtaaatttccagaaaattgtttccccagggcccctccccttgaagaaattaaacaggaagctggagtagactgtcccttctttcccccacctctcacactccaaagctctgtttaactctgtgggccagtggctagattccccaacatggatgacagagaatacacatgcaataagaatgttttcgctgccaccagccactcacagacacactgtctcccaccctctgaaggcattgtgcccaatccccagccactcactgtctagtcagggctgcccctgcaggacttgccttggctgaggaccagctagcttcaagccactctgaagtcagcttgctgtttcccctggagcctggtaatacatccttcttcaggtgaacaaaagcagaaaaagcccagtgaaccccactgcaacaaagagcctgccatcagtcttccttctgttcctgcctatctcatcacccaagggctatcccagagcccactatgttctaagatctattcctttcaccaccacccagccaaacaactatccagacaattccttgatcaaacaacactgccttcttgagtttaaattttattttacaaaaagagaaataaagaaaactgataggcagttatactgacttacaattgttctgtttgcttttttttaaaaaagtgacatgaaacacaagtaaaaataaatacgtcatagaaacagccagttgcccagtctctggggcaggagcgcctgccctgctgagaggagggaagcccatgatcacaccagcagctggatcacccagccacagatgctcctcgaagccaggcacaggtcccaggcctcaggggcgtcctgaggaaagaagacggaaaaccaaagccaggtgccaggaccctggggccacctcattatcccccactcctcctggcagcagtctggtcttagtggttatccatagcgaccccccttaacccacctggaccctcttcccctgacctctctgaagatggtacaagggaaaaacctgtcttgggcaggctgggggggattcttctggtgagtccccagcccaccctgagtaacacaaccagataacagtcattttacacccaggtgcacatgagcacagcacacaaacacacacacacacactcacacacacacacacacacagctgggctgagctctcttccagggagggtcctgggtccagtcacagtatgaggtcctctctcttctgaatatcatcccagtagtggcagcagagagtacccaaacctccccaagccctctgcattgcagacactgcagcctgcttggctacccctccccaacacactagattactatgtcaaatagacctgcaaaagggaaaggtgcacactcaggtccctgaagagcaaagaagttggacactgcctgctcaagaagttcattgttataagactcaggtattcataaaaggcctagggctaagctagtagcacagaaaagccgttaaggggatcacagcagaatacacagggcagaagagaagagttggcagcaggggaacggagtctcaaggtgaccaatagagagcacaacattctcaaatagtccttgaggtgctgattcctgggagtagtcagcagagggccagaacatctcccaggggtccttttggggaaggatgacttcacttagttttaggggtgaagagccactgagctgggtgcacagaaggccatggctcagaagggaaagactgatctgagaaatcaaaaggaagtgggggccaggagcagtggctcacgcctgtaatcccatcactgggaggccgaggagggtggatcacttgaggtcaggagttcaaggccagcctggccaacgtggtgaaaccccgtctctactaaaaaatatacaaattagctgggcatggtggtgtgcacctgtaatcccagctacttgggaggctgaggcaggaggatcgcttgaaaccgggagtggaggttgcacggagccaagatcacaccattgcactcaagcctgggtgacagagcaagactctgtctcaaaaaaaaaaaaaaggaagtgggaagcagaaggtaatatccagaacactagtaacaaggaatgtaaagcccccagaagaccttccccatgggatgaggactcaatttcagagcaatgccaggtttgaatagactcacacagagggcccttctctgctgacaactttgggagtgatggtcctacccaggccacttaagtttggctaagtgtttcaaccaatctgcaaaactgtaccccagcactttgcttcctgctcctgaattgagaaatttcatatttagttgtgaatcacaagcatatagagactccacacactaattcctagggaagagagctccaaggatcacaagcatatagagactccacacactaattcctagggaagagagctccaaggaccagacagaattatccttaaatcaggagatgatgagatagatgcctaaaaagcataactcaaaggggtgtggacttcatagatatccaatctaaagaaaatgatatgacccaacatggttcacttcctttcttaaatagctactttgtccctgttcaatttttatctacaaatatattaagaaaaggaaatcaagcatcactataaatggtaaacctcaatcattaagtagtactgtgttccccaggctgagaacttggctaaaccagatgaatggggcttgagaggcccttgaaaacattccatggaagacaatggtaagggaaaacgcctaggcctgattttctgccctccctcttatcaccagccaccctgcccccctcaggcctggataatgggtggaagacaccaccaagtgtttatgatcaaagaaactataaaacatggttcttaggctctgagatacttcctgcttccctcacaaacatgcttatgtttggtgtgcatgcacatttgcctatcagcacatataaagagacagtggaaaagtcagaagtgttttcaggttattttctttaaaaaaaaaaaaaaaaaaaaaaaaaaaaaaaaaaagcaaaaaccatggacctggtagcactccaatttcccatgatcccacccccaacccctctacacaatagaaactgcacatataaaagaaagccttctctagtcaggtcagcctcccagaatgatggcctctgctgagtagaagcaagacccagtccctggaacactggatagacagtaggcatgtgctgcctctcagaatacccatttactttctgtcaacttcaaaagccaagcccatccctccagggaatggtttcagttcccggctgggaaggtttccggattcttggaggctagtacagtgatttcctagaagtgaacacagaaatactacccccttctcccgacaacacacacacacagacatacacatgcacacatgcatctctgggatcccagtgctccagggcctgagaggcatcagtgtaacccaggttctgagtgtgtcccataaattggagattcagtctagctcactcctactgcaccagcctcaacctgagagctcactccaactgagtcccttcaccatccattcttgggatgcatctgaaagagaaagcactggttggaactgctatttttaaattattaaaataatttgcatagctaaattgtagatctaaggcttccatgagtagaagagttaagtgtctggcagggtgcttatgaaaacacaaagcttcttaagttccacttttggtgttattggacagcagacaaacacacatatacacatgcaccccatccatcatctccttgtctcttctctgaggacaataccccagagtctgctaaggccctccaaagatggaaatgggctggtcagaagagctgtaggagctactactgggatgacctgactaagctgccttctgggctgggaagaggcaggtacaccacctgcccagtaaggagggagccatgggtaagtggtaaagctctaaagccaaagtttgttcatcataaagaactgtctggcaaagtgttggggtgggggatacagagggggcggggacaccagtaggaagacagccagtgtttatgcttaaggactagacgaccctcccctggcaatggcaataaggggagacccagaatgactggtgtgttcttttaagataaaacccagacttagggctcctacagagaaagggctcctccatgttccttcaaagatggaggcagcagacaccaggcctacatggaccacctgaagatattttcgaacatgaaatcaacagtccctcaacccagcaaccgcctatccacagcttcactattcagcatagagagccaacatctaacatcatcccaggaggacacagctccaaatctggggtctcttacttcccaattgcaaactccatgatcacaactttcgatttctgtggaatgagtcccaccctccactaactatccagtctcaggattccctgatcttcctgaaaagccatctctcaaaaatatagttgtttaatccaaaccttggtcaaacctaactcttcccctggtcaatttaccatccatccaggattgtttttcaccagtggctatagggtctgggatatcttaaaacttccctttctatcacctaccctccttacccctaacctccccccacccccaaataaacaagacacatgaaaagtccaagtaataaataattgcccataagaaataaattaacatggagctctctaaaggggaaggaaaggaacagaaaagactaccaggataggcagctctcttgggaaagaatgttcccaaagacagaaatgggatgtgcgcttctacactcagatgggcgagcaagcaagcagacagcataagcaaggcaggaaggaaaagaggctgcactgcccctccatccctgttttgggtccctgatttcccgctattgctgctgtgttggacttttttttttttttttttttttttgcctcttttgttaaacagcaacagagctctgccactttggccaaccaccctcctttgtcctcttccttttccctcctgccaagtgtcc

SEQ ID NO: 808 - DNA, 3422 bp, Homo sapiens
ggagagccacgggcccgcgcccgagacccgcccgaagcgcgccgagctcgtgtgggggcccaagcccaagcttcctggcgccgggcgccctcccgtccggtacttggagcaaacggtgtccatgaaggaggcgagtggcaaatgatgtggtcaggaccatggacaggtctccttggttgaaaaggattcccacccactgactctcagatttggtaatagtaagtctgttttggtttcgtttggttttattttgttttgttttgcccgaatcagccacatactcgtctcagatctccgctgtggagaaacagctagttggcaaaaagcaaaaaggagagaggaatcctgagcacagcagtggtctctctctctctctctctctctctctctcacacacacacacacacacacactcacttcaccccttagcctcgctcttgataagccttgctgccacacagagcttggcttacctcttggaactctgagttggaatttgtctacacattgcaaacgcacatttgaagccacacaaaagtcagggtcagacggacgttttgacaaaggacctggaaagcatgtcacacgcaggtttttaaaaatttgtaaacctgtgaccattgtgaacagtcccaggccaaccctgagcacaacaacaattggccacttagtttttacttaagatacttgaaccgctcaaccatttacccaactctcaacttcatttagtaatttgagaacctggacaatcaacggcataaacaacattgagaaatagggagtttagtgattctctcttgtggaggaaatgctaattcctagagcaaaatagctatattagggactgaaacaaagaagaaaatattttacacttatgtaagtaaggttggactgtaaatctagagcagaaactgtcttccattgcttttatataacctctccctcagtcgcattttatgctcaatagacattcatcctttaccattttctttagttcagtgagtatctgtgaagccggcactgtgctgaaaactggctacaagcaagaattgttattgaaggatcaaagaaaatactgttttactcaggaaacattaaaatgcctatactttaggaaagctccatgagagagtttatgatggacatctagaggattcgggtaaaatgtttaatgacattttccccaggcagcctcccttaaaacagtcttgaactccaagacattgatctgaacttgacaccacagttgtaagttgtggtttctggctagttctgagtaacccaattgttcaaacttttaaagaatttcatattgaaagcccgaaaaatgtattcatcctttcctcaccaattacatagttactaagtaaataaccagattatgtgagtttccataacctagattaacatcgctactatttgtccaggagacttatttgtccaggagactcatgtggatgaactggggaagaaggaagatagttcctagaaggaggttgttggacagaaagaacttaacttatgcctagtgttccattattggaacgctaagcacgcgggagttgtttacatcctgctgctcaaggtcatcgccaaggtctgattgcaaaaattctaaaaattgcaacctcagggataaatgagttaagtagtaactacaaaggtactgtactgtctagacatccacctcttgtctaccttctaactcttttgcaagcacttgcctttcatcgtacttccctgcagttcccttacagcagagctatccaaaagaattgtccgcaactattaaaacactctgtatttgtgctgtccaatacagtggcccgtagccacctgtgactattgagcactttaaacgtagggagtgcaactgaggaactgaatttttagctttatttaattttattcagtttaaagtttaaaaagccacttgtggctattgtctgccatatcaaacagcatagacttagagctacagaaatggcatggtagtgttcagccaggaactaagaaagaagattatttaatgagcacttggtgagataaactgtaatgtctgtagtgggaaaagaatagcagcaatttcccatgtttggcaattctatctaatgacctgacactgttaagaaatatatccatcatgctgtgtggaggtagttaaagatggagatggaaaaaaataaccagaaatcagaataattttgttttctcttccatttcctccagcaaatattttcctcaagagttgtcatttactctactatagatagcacagttataacagggaaaaactaacatgaaatattctagaattatttttgttcacttagatcaaatggtagtttttttcctgccacctaaagctttagaagtaacacaagctctagcaaagaaaagaaagaagtaagcaaatagcacggacactaatttattatcctgtgctttccttccatggtatcttctaagcgtttcattcagacagaagggccaactacacttccttttcctctgtaactatgatattattcctgtataatctgctataattttcttattgctcactgaagttattgctattggctagctgcatagagcagtacacagaggtttttcaaaagaataataacacagcacgatactggcctgtcagctcgtaggagtgaacagaacttttaaacatatagaccaatttaacacaaaatgatcaacaagtacatgcttagtaggatacaggctactgtaactaagtgttcttattcacaacaaagaagttattattttgttctaggtaacagtacttgactatatttaaaaccttttttcacagctgagtgttcccatgataatgacaagtgacatttatatagtgactttcactcagaggtcaaaaagtgtgccacacaccttttacatgacataaatatgtcacccaccagtaaatacagccacctatcatgtagaaagcggaagcaacttttagaagccctaaagaatatatatatacaggaaagaaattgaattttacacctagaataaattgagttagatgagaaaatggtcttctgctgcaaaaacattattcaactcttcttggtttatataattgcaaatttggacagggtaatgatgtgtggaatagaggaaggagagtcaaagcaaaagataatttaggataatctggaaaagagatgattagggcatcatttagaaaaaggaggtaaaataatgggcttgatcagaccagagagtctatgagggtcactaagatcttttattgcttacactgttcaaatacaatgctgtcaaacattgttctttgtataaaaataggtgctcaataaattgttgttaaatgaataaattataacaggcttggtgtcatgtatcctttataattgtagttcttaaactctgatgca

SEQ ID NO: 809 - DNA, 2679 bp, Homo sapiens
gatctatagtgatttgctcagtgccttgcacacaggcactgttgggggctgctcccagaggttgtgttgcagggactggagagaggacttcccagtacagggggtggccctctgatcaggtgggggtgggtggcagcagagcatttggtaggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacaggggtacatgggcagggtggtggtggtgagagaattgcctgaatcagctgccaaatggtgcccaggttggaaaagcaaatgtgcacacatgggttcttcccactctaaccctgaggaattagaggcctgcttctgacacagactgggcagtggctagtgactctaggtatagagtatccaggccctgctcacccaggctagagcttagggagccagaaggaaggaggtgcatgttggggtgcaggacaggagggaaaaatactcgaattgcaaggtgagggcacagtctatttatattgggttgaattaactcctccccctgatgccactaaagcaggaatcacactgcagatggcactgatttgattggcaagagacatgccaggaagaatattaagggaccggacccctataattaggcctaatcatagcctgttgtttgaaaagggcatgaaggacattcatcaggcctggcactgtgccctagacctgctctcctgggtagtgggaccctccgtggcaacagaggtgtgggtgggcctgggtgagtgtggcaagaaatgcctcggaggctctatttggccttaaagtgctgtgtgaccttggataaactgccctctctgaatctctggtcctttccatttcccattctccaggctgagaactgcactgtgatatatggttattcccataataataatgtgtgtatcatgcataatgcactgcacctcttcaccacgctggtgcccactcttctgctccccctgccggattcctcagccccttctaccctgatggttctctcctttcctcctcaggccagcacttcccatgatctgagatgtccgtcctccttcctcttcaactttttctccagcagtgagttcctcctcctaactgaggcttccaggaaggatatcctctgcttctcagacctgaacctgccttgaatactcatgaggacccaggagctactcctcacctcccacttctcttccctcctgtcagataaccaaggcacggccaactgatctccaaccatctgaggaacccaaccgtgtgagaccacccacacctttcaagaatgttcctcccctccccttctttgtatttatactgatgcaaatttgctggccatcttaactcagtcctgtgcctcagttctcccacctgtaagatcaggaggaggataaagatgtaagactttctgcacacgttttaagatgaattccttgttaccacatctgagggtgtctgtgtttactgtactatccacgtgagaggattgtacagacacgaatctaaacaaggaagtagcaagtccattcaagcattaagaggctgattagtggtttattcattctgtctgcaagcatctactgatcatctattcagtgcagaccattatcacaacaaaggtgaataagacactatgcaatagccagggaaacagcctcaaaaacagttaaactctaatccagccatgagtacaatgctaaggagggacaaattcccttctagggctagggaagtcaggaaaaaacctctcagcagaatgtgtgcctctctaccaggcccagggagaaggtgcagagacagcattccaggtggggagcagtggctcacacctataatcctagaagttgtgtgggaaccgctgagcggaacaccctcccccagcgggaaatccgggacacgcaggagcctcagtgaatccgaccattgtctcatctcaccaggtcacccggctggaaagagtggcagagccccgtctggtcaggaactgggttgggatgagctccccggacaagcggctggatgatgtcttgtacctgttggagagactgcagggtttgaggagggagagaagagccaagtcttggaggcgctggacttgctgcgacacaggaaaacgagatgtgcagggcaagggatggcgatgaggaggaaaggggccacttggatctttcctaaggtaggagagtagtcacagaggataagagtccagctggagtgaagcagtacgggggtagtccttctattttagggttgccagataaaatacagtatgcaaaatcaatgtgtctgatgtcttgaacagctgttgcctgccaaaatggacaaagaaccaagagcagctgcaggccacgcaccaccactgggattgctgtgaccttcctgccttgcccctgggtcttaaatcaccaaactctatggctcacactgggctgacactgctgaccttacagccttgcaaatgatgtcatcaccatacgttcttcactcatgacgtggcatggatttgaccaaaggcgtgat

SEQ ID NO: 810 - DNA, 1055 bp, Homo sapiens
gcaagctcaggtggcaggtcccatctgatggaggagaatcaattcaaggagatgcccttcctttacagaacaccctttaacagcatccaggaggaacgagaggctgcaatactgaggctttcaaagtactcacgaggatgtccgagaatggctgtgatgccaggcttctggcaggttccagactccatcacaagcccagcatccctgcaccagatctgacatcgctgctgttgtgccagctgtttatgaagggcctgagtagctagcaggtttttatcaggagccctgctgggggcttagacaccaaaagagaagactcatcctctgtagttcttcttgtgaatgtccttttagaaaaacaattagaaccaaccacaagcaccaaagtcctaatgggatctcctgcgagcacatatcaagcaggattgttgctatttctcctcactggctctttggacagactgtgtgagctcctggagggttccactgtatctaccctttgacactgaccagttggcacatggtgacatattccaatgtgttgattgcaaatgtgaacgtacagccagtgctgtgtgcgggaggactctctcctcctcagtggggccacaccgtgcactattaatggagccccactcctttgcacagcctggccatgcagtggctcatattgaggttttagccaactgaaatctcccgtgcatttttctgacaagccagctaggcctctgctatgctgtccttgtgtctttcatttgatgaccttaagggtgggactgttttatcttaagttacaggtggtcaagtccagcccaaggacagcaactctgagggtcaagcctcataggctaactggatagatgttctctgctttgccacccactggagcccgacctgccccactaatttatatttcccctggtctcattttgtactttttatttataattcacccttaaagtgtatgtgtctcttataagctgcctccgatctttcatggtatgaggtggttacctaaataaagaaggagatttggcctttgtttttatgtaaca

SEQ ID NO: 811 - DNA, 11532 bp, Homo sapiens
agcacgctggcggctaccaagctggaggaggcggcgggcgcgagactgggaatgcgcagggccccctccctgcccccacagcctgggccacgggccccatcttccccgctgctgcgcggcactcagtgcccaccccccgacgaggccggcagctgctcccacccgggggcgttgtcagctgcgccgggccgcgcgctgggaggcgagggcacgcatggggagcctccgttgatgccaccaccacgccgccctccgaggctgcgtcccgggaagcccggctacccgagcgctccggcctggcccggtgccccggacctgagtgtgtccgcatggaggagccccgactggcccaggcggccgtggcggagagcgacccccgagaggtgtgggaggagacccccggctgggcacccgcattctgccccagccccaaggcctggtcgccggagccgcctgcccaccgcctgcaggacttcgacacactggccaccgtgggcactgggacgttcgggcgggtgcacccggtgaaggagaagaccgccaagcatttcttcgccctcaagttgatgagcattcctgatgtcatccgcctggcaggagcagcacgtgcacattgagaggtgtgtccggaaggaatcatccgcccgtccctcatctgcgtccggaaggaatcccttcctcatctgcgtccggaaggaagtcatccgcccgtcgctcatctgcgtccggaaggaagtcatccgcccgtccctcatctgcgtccggaaggaagtcatccgcccgtccctcatctgcgtccggaaggaagtcatccgcccgtcgctcatctgcgtccggaaggaagtcatccgcccgtccctcatctgcgtccggaaggaagtcatccgcccgtccctcatctgcgtcccgaaggaatcatccgcccgtccctcatctgcgtccggaaggaagtcatccgcccgtccctcatctgtgtccggaaggaagtcatcagcccgtccctcatctgcgtccggaaggaagtcatccgcccgtccctcatctgcgtccggaaggaagtcatccgcccgtccctcatctgcgtctggaaggaagtcatctgctcgttcctcatctgcgtccggaaggaagtcatctgctcgttcctcatctgcgtccggaaggaagtcatccgcccatccctcatctgcgtctggaaggaagtcatccacccgtcgctcatctgcgtccggaaggaagtcatccgcccgtccctcatctgcgtccggaaggaatcatccgcccgtccctcatctgcgtctggaaggaagtcatccgcccgtccctcatctgcgtcctgaaggaagtcatccgccctttcctcatctgcgtctggaaggaagtcatccgcccgttcctcatctgcgtcctgaaggaatcatccacccgttcctcatcggcgtcccgaaggaagtcatccgcccgtccctcatctgcgtccggaaggaatcatccgcccgtccctcatctgcgtctggaaggaagtcatccgcccgtccctcatctgcgtctggaaggaagtcatccgcccgtccctcatctgcgtcctgaaggaatcatccgcccgtccctcatctgcgtctggaaggaagtcatccgcccgtccctcatctgcgtctggaaggaagtcatccgcccgtccctcatctgcgtctggaaggaagtcatccacccgtccctcatctgcgtcctgaaggaatcatccacccgttcctcatcggcgtcccgaaggaagtcatccgcccgttcctcatctgcgtcctgaaggaatcatccacccgttcctcatcggcgtcccgaaggaagtcatccacccgttcctcatctgcgtctggaaggaagtcatccacccgtccctcatctgcgtcctgaaggaatcatccgcccgtccctcatctgcgtctggaaggaagtcatccgcccgtccctcatctgcgtctggaaggaagtcatccgcccgtccctcatctgcgtcctgaaggaatcatccgcccgtccctcatctgcgtctggaaggaagtcatccgcccgtccctcatctgcgtctggaaggaagtcatccgcccgtccctcatctgcgtctggaaggaagtcatccacccgtccctcatctgcgtcctgaaggaatcatccacccgttcctcatcggcgtcccgaaggaagtcatccgcccgttcctcatctgcgtcctgaaggaatcatccacccgttcctcatcggcgtcccgaaggaagtcattcgcccgttcctcatctgcgtcctgaaggaatcatccacccgttcctcatcggcgtcccgaaggaagtcatccgcccgttcctcatctgcgtctggaaggaagtcatccacccgtccctcatctgcgtcctgaaggaatcatccgcccgtccctcatctgcgtctggaaggaagtcatccacccgtccctcatctgcgtctggaaggaagtcatccgcccgtccctcatctgcgtccggaaggaagtcatccacccgtccctcatctgcgtccggaaggaggtcatccgcccgttcctcatctgcgtctggaaggaatcatccacccgtccctcatctgcgtccgaaggaagtcatccgcccgtccctcatctgcgtccggaaggaggtcatccgcccgttcctcatctgcgtcctgaaggaggtcatccgcccgttcctcatctgcgtctggaaggaaatcatccgcccgttcctcatctgcgtccgaaggaagtcatccacccgtccctcatctgcgtccggaaggaagtcatccgcccgtccctcatctgcgtcctgaaggaagtcatccgcccgttcctcatctgcgtctggaaggaagtcatccgcccgtccctcatctgcgtcctgaaggaatcatccacccgtccctcatctgcgtccggaaggaatcatccacccctccctcatctgcgtccggaaggaggtcatccgcccgttcctcatctgcgtccagaaggaatcatccacccgtccctcatctgcgtccagaaggaagtcatccacccgtccctcatctgcgtccggaaggaagtcatccacccgtccctcatctgcgtcctgaaggaagtcatccgcccgttcctcatctgcgtctggaaggaagtcatccgcccgtccctcatctgcgtccggaaggaatcatccgcccgtccctcatctgcgtctggaacgaagtcatccgcccgtccctcatctgcgtcctgaaggaatcatccacccctccctcatctgcgtctggaaggaagtcatccgcccgtccctcatctgcgtcctgaaggaatcatccacccgttcctcatcggcgtcccgaaggaagtcatccgcccgtccctcatctgcgtctggaaggaagtcatccgcccgtccctcatcggcatcctgaaggaatcatccacccgttcctcatcggcgtcccgaaggaagtcatccgcccgtccctcatctgcgtctggaaggaagtcatccgcccgtccctcatctgcgtccggaaggaagtcatccgcccgtccctcatctgcgtcctgaaggaagtcatccgcccgtccctcatctgcgtctggaaggaatcatccacccgtccctcatctgcgtctggaaggaagtcatccacccgtccctcatctgcgtcctgaaggaatcatccacccgtccctcatctgcgtctggaaggaagtcatccgcccgtccctcatctgcgtctggaaggaagtcatccgcccgtccctcatctgcgtccggaaggaggtcatccgcccgtccctcatctgcgtcctgaaggaatcatccacccgttcctcatcggcgtcccgaaggaagtcatccgcccgtccctcatctgcgtctggaaggaagtcatccgcccgtccctcatctgcgtcctgaaggaatcatccgcccgtccctcatctgcgtccggaaggaggtcatccgcccgttcctcatctgcgtctggaaggaatcatccacccgtccctcatctgcgtccggaaggaagtcatctgcccgtccctcatctgcgtctggaaggaatcatccacccgtccctcatctgcgtcctgaaggaatcatccacccgtccctcatctgcgtccggaaggaggtcatccgcccgttcctcatctgcgtccggaaggaatcatccacccgtccctcatctgcgtcctgaaggaatcatccacccatccctcatctgcgtctggaaggaagtcatccgcccgtccctcatctgcgtcctgaaggaagtcatccgcccgttcctcatctgcgtctggaaggaagtcatccgcccgtccctcatctgcgtcctgaaggaatcatccacccgttcctcatctgcgtcctgaaggaagtcatccacccgtccctcatctgcgtctggaaggaatcatccacccgtccctcatctgcgtcctgaaggaatcatccacccgtccctcatctgcgtctggaaggaagtcatccgcccgtccctcatctgcgtcctgaaggaatcatccacccgtccctcatctgcgtcctgaaggaatcatccacccgttcctcatcggcgtcccgaaggaagtcatccgcccgtccctcatctgcgtctggaaggaatcatccgcccgttcctcatctgcgtccggaaggaatcatccgcccgtccctcatctgcgtcccgaaggaagtcatccgcccgtccctcatctgcgtcccgaaggaagtcatccgcccgtccctcatctgcgtccggaaggaagtcatccgcccgtccctcatctgcgtccggaaggaagtcatccacccgtccctcatctgcgtccggaaggaagtcatccacccgtccctcatctgcgtccggaaggaagtcatccgcccgtccctcatctgcgtccggaaggaatcatccacccgtccctcatctgcgtcctgaaggaatcatccacccgtttctcatcaggctgtgctggacggggcatgactagcgcttcctctgcaggctcatggagtatgttccgggctgtgagctcttcagctacctgcgcaaccgggggctcttctactctgcagagatcatctgtgccatcctgcactctaaggagatcatctacagggacttgaagccggagaacatcctgctggatagggacggacacatcaagctcacggactttgggttcgccaagaagctggtagacaggacttggaccctctgcggaatacccgagtacctggcccccgaagtcattcagagcgagggtcacggaagggctgtggactggtgggccctcagcatcctgatattcgagatgctctcgggatttcctccatttgtgtgtgtgtgtgtgtgtgtgtgtgtgtgtgtgtgtgtgtgtgacaacatgtttggcatttatcagaaaattcttgcagacaagatagatttccccagacatttggatttccatgtgaaagatctcattaagaaactgctcgtggttgacagaacaaggtggttaggaaatatgaagaacggggcgaatgatgtgaaacgccatcggtggttccgctctgtggactgggaagctgttcctcagagaaaactgaagcctcccatcgtgcccaagatagcccgcgaaggcgacacctccaacttcggaacttaccccgagaatgactgggacacagccgcgaccgtgccgcagaagggtttagaaatcttcaagaatttctgaggacaggagctcacatctggaagaagcaggaaggctggaatctgcctgcaacaaagagctgctcctgagcagaccagtagcaatgtcttcttcacgtgataaggacatttccacttttctgtctttgtgcctgtatgtatagaaacagatcagagcacagttgaaattaatgtaactggcattatttaagcaactggaattccacactgtaggaaggttttgaaaattgtttgcttgtagattttatcttatcctttagtgttgtgttcctactgtgatgtcttggtttttctcatagacttaagtttataagtttgaactggacttgttcaattataaccacaaattgtgtgtgtgtgtgtgtgtgtgtgcatgcgcgcgcctgtgtgtatatatagaagtcattatggcagatccacagaaattgtgcaatgatgtaaatgttcatacttcacagagcctataatttttatttttcaatttgttttttcaaaaatctcttctcttggggacaacatctgaagggtctgttgcatggatttaaaaaaatcatctcacatgcattttttagtttgggtgaagaaaacatcatggggaggtccatcttcagtatctttagtgcttcctacctggtaacttgagactttaaaagaagaaacaaagagaagaagatatgggagtgaatttattccaagaatctacaatgacattgaagttgttggaggaatatactgtatttaaaaaacctgtgtcacattcaaaaatttcatctaagctgggcgcagtggcttgttcctgtagtcccagcacttcaggaggctgaggtgggtggattgcttgagcccaggagttggagaccagtctgggaaacatggtgagatgtcatctctctacaaaatacaaaaaaattagccgggcatggtggcgcttgcctatagtctcagctactcgggaggctgaaatgagaggatcacttgagcccggggaggtccaggccgcagtgatccgagatcacaccactgcactccagcctgggtgacagagtgagaccctgtctaaattaaaaaaaaaaaaaaggcaatggctttgtgcttttgaaggtggaatgaaaggtggaatgaagacacatccaccttaaggctttaaaagaccatgaagctgggtgcagtggctcactcctgtaatcctaggatttggggaagccaaggcaggaggattgcttgagcctaggagtttgagaccagcctgggcagcatagcaagaccccatctctataaaaggaaaaaaatgttaaaacacagtgaaactgcagaaacagaacatagccaccctttttcattaatgaccttttcttcacgtggtggtcaactcagcaggtgagaataattagtaggttcagtagaataaagtctttacaattaataacttagtggaaaatgatgttcagatgatgaaatgtggaaatgttttagacagctgtattttcagcctgtgtgtctcagtcaccatcctgttgggattaacagttgagggccatcattttctaaacatttcacatgcagtttcccataatttttaccgtgaatgtgaaaaggtgaaactggtgctgacttcagcggcaggtatactaaaattagaatgacacagaggagattagcatggccccctgtgcaaggaagatccagattcatgccgcattccatatttttttttaaaaaaggttacactgtgcaccgagatgtgcagctagaaggaagagcatgaagtctcgtgtttgctgactataaaaataaatcatagtaataatattgttgaaaattctgctttaaaaattattaataaaaccataaatgaaacactattcttgagcacactttaaaaagtacatagacccataagtccatgtactaaaaaatgcctatttttaggttgcctgttttgtaatccaggatttcatactgagatgaaaattagcatcaggaaaagcctgaaatgccttgccttaattgtgaacagatactggggaacctgccccgatattcacgtaggttcttttctgttttccttaagcatcggccagcttgagaaataaagggacagagtacaaaagagagaaattttaaagctgagcgtccgggggagacatcacatgtcggtaggttccgtgatgccccacaagccacaaaaaccagcaagtttttattagggattttcaaaaggggagggagtgtgcgaataggtgtgggtcacagacatcaagtacttcagaaggtaatagaatatcacaaggcaagtggaggcagggtgagatcacaggaccacaggaccgaggcgaaattaaaattgctaatgaagtttcgggcaccattgtcattgataacatcttatcaggagacagggtttttgagatcaaccggtctgaccaaaatttattaggcgggaatttcctcttcctaataagcctgggagcgctatgggagactgaggtctatttcacccctgcagtcttgaccataagagatgaccacgcccaggggggccagttcagagacccacccccaggcgcacattctctttctcagggatgttccttgctgagaaaaataattcagcgatatttctcccatttgcttttgaaagaagagaaatatggctctgttccgcctggctcaccggcagtcagagtttaaggctatctctcttattccctgaacaattgctgttatcctgttcttttttcaaggtacccagatttcatactgctcaaacacacatgctgtacaatttgtgcagttaatgcaattattacagggtcctgaggtgacatacatcttcgtcagctgacaggattaagagattaaagacaggcataggaaatcacaagagtattgattggggaagtgataagtgtccatgaaatctttacaatttatgtttagagattgcagtaaagacaggcataagaaattacaaaagtattaatttggggaactaataaacgtccatgaaatcttcacaatccacgttcttctgccatggcttcagccggtccctccgtttggggtccctgacttcccgcaacaaacagatatgcatgaaaatgaaatatgcaaagcacattgatgaccttgttctttacggacattgtaatcagcctctagccatacagaacaaatgagaaattagaagcacttccaagaacgtgtgatggtgtgaaacccacttttgaccatcatgcacatttcaacatttgaagtgagacaggctacctggtaactgccccatggcggggtcatagtttaaatggcccaatgtcctgtagaggttaatttaatcaaaatgagctataaacatagaacaatcactatgtataattttaaaatagtttacctggcccgtcatggtggctcacgcctgtgatcccagcactttgggaggccgaggtgggcagatcacccacggttgggagttcgagaccagcctggcccgcatggcgaaacccccatctctactaaaactacaaaaattaggcatgctggtgggtgcctgtggccccagctgctcaggaggctgaggcaggagaatcgcttggattcgggaggcggaggctgcaatgagccaggattgtgcctctgcactctagcctgggtgacagggcaagactccatctcaaaaaataaaaataaaaatagtttatctgggtgggcattccaaaatttccgcatagatgatcacgtgaaacaatcactgtgctaaatgtggaggaaaattcatcacgataatcacaaaatttgtatcagaaaaaaattacaaatgtactttgtttcatgtaattttatgagttggaagtattttcttaaattggaacactataagataatatctttaggaaatggatatgccacaataggaagtatagtggggcaagtcttgtttttctcaagggaaaagccaccagcctgctttcataggcattgataaaaccaggaagaaaataaagtcacaaccaaatagtatacactgtctctactgaattcttctaattccttcccaacagaagtctaaatcctgcttagcctaaacatatctatagccagcgatgggcaaattatatttgctgtcagcatgatagaataagaatcagaaaccccccagcagtggggtaagatcgtgcacttcatcccctcaaaatgctgtcaaccccattccctctccatgccctcaaacaactgcacagtcacttgttagtgaatttctcgttcagcgttttgtttttttctctccatacttaaagaccaaatcatttgtttgctctgaagaaaaagaaaaaacaaaacaaaacaaaaaaccacccaccaaatcatttgaaatcactacccgttaaaaaaaatcaccagtggaactaaacagttgagtggtttgggatgtgttcgccatttctgtgtttgacctacatggcctctagttctttggaccactgtaactgtgaaaccatggcttaatactgttaaagaccccaaggctcaactctgtagccagggtgtacctcaggctgcacaaatatcacaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaacctacctagcatgcattttacacacattggaggagtcttatgcactgtttttctctgttgctgatggaggcaagaaggccttctaattagtctaacttaaacggacgggattcacctaacaaaagcaagaagaaaagcacaagaacaggtgtcttaatgcatttggataatttatttggggtgtgtgcgtgtgtgtgtgtgtcttggtggaggtgggggccgtgttctcaccaagccttttcataatcaagtttgctttgcaaactttatggccttacacccagcagaacagtccttgctaataaaaggaggatgccctgtcacagttctctgtaaattatcatgtgttgggaagttctgttgatgcttagtttgatcttccatggtggacacatctgttctgtatgtacaaggcattacatgtgtgttttagcggatgggaattgaagcctttccacagtccttgtgctctgagatggctgttgagctctgctcagctgtcgtagctgaattctttttttgtgctgaacactgggcagcctcaccatgttgtcaatgtgcttctggggcccctgtgactgctgccagatgccatgcacacaagcagagtgcctttgcaggtttgtgcaccccttggcgagctggaactgggagccctgtggggtgatctcgccttctcatggggggtcggggaggggagtgcctatttttaatcttgtctgtttgttgcaccatggaaatcactgtgatttgtatatatgccctaggaaatttttactgcagtctaatttatgtaataatgttgattccaggtttgtttaataaagctttgtatcttttaagaaaaaaaaaactgtagcatgtagaggaaagtgcactgggataatccaaggccaggctttgaggttccaccgctacattatgtgactcttagtctaaaccttttggtgtaatttctttggtctgattatttataagtagcagataataaatgaattttatactacaaacacaagtgacaa

SEQ ID NO: 812 - DNA, 4068 bp, Homo sapiens
acggagctccagccagggccgcggttcgcctgcacgtcacggctactcaaacccaagcacgtcccgaaagcggtattttctgcgtctgggaggtttttgcatcctcagttcccaccgctggggctggcggcgaccaactcgcagacctgtcgcagccagagagctgtcatttcagtaccgggattcagaattgatccagtccgcagcggagggggcacatcccagctaccgagctgctgagtgtctctggctggaacaatagtatttttttctctgcgaggctgcaattaacatcttatttgttctggctccatacaggctttgtcaggatcgcggtgcggcgaccgacgttgggctcttgcattgctttgtgcttggcaatggaatcatggtttcggggtctaaacttttgtttcgttttgtagtcttaatgtatctgattctttttcaagtttccctagtaacaggtttggggacggggtgggaagaagcgagaaaaggggtgaagagaaaaaaccagattatatagaaaggaaaaagggaaaagggatgtttccccaccttttaatctaactatctatctgtctgtctatctatcatcatagatagtcattttgcctcctggacagttggctgacgaagtgtctgataaaccagcttcagatacatgctacaaaaggctactgagctggcctgatgatgatccttctgagatatatttatagcagatgatttgtggatgataactacgccaagcaagacactgtctccagtaaccccaggctcgtctgacttcctcaggggattataataaagaatcacaaaaagaaccctatatggacagtctggtctctggacactaacaacagcacaatccaaaggcaaagaaaggaggaaccaccttgtttcatgtctgcaagctgctccatatgaaagcattgctgacatgttgacccaacagcaaaaagagagcagcagtttacacaccctcagctctctgtcctttcctttctattgatgttggtccacttttatgactgaatacatattaaaatcaccatttcaaattataattatctgctttcattggtctctttcacaagtctatgtctatatttatgtttacatatataaacacatatacacatattttatacatacatatgtatatgtatgcacgcattatttgtaagtacacatacacgtgtgtgtatatatatgtatatgatatgtatatgtgtatttcagttgatacacatatatttgcttgggaagtttcactacattgctttgtatttctcttttataaggtaatgcatttaattccaaaactaccacattaattgtataaattgattattacataagtttccttgatgatttacagaagaactattgagaggtcagtgttagcacatcaaaatatagtctggtatggcattttaaattgacccaggtatctaatattaaagcctttcaaatttatctctcctgctattattttattaagattactttggaatgatgaggttataagtgtgatttatttctgtttcatctttttgtctgtatgtgctaagtttagtccctccactttgagaataaccctataatccaggatcattgcttaaaattcagtatcatttgcagaattctcatactcaaataagaatgtttctagaatatgtttactcaattttagaaagtattttctctttccttctttctgtcatagtttttctgatattactgtattaccacattctaaactctgtgacttgttattttcagtaaggctttaagaagcatggataggtttgtaggttatttcttgttaaatatgccttaattttttagtatttagtattagtatttagtttttagtatttagtatttagtatctcccatatatatatatgcacacatatatatatacacatatatatgtacacacatacatatatacacacacatatatatacacacacatacacaaagctttggaatgttaattaaatgatcaaaatattacaagattacattgttatgagaacttatccttaatattagcatatttactataaagttaaacaacttcttctcctctgtctcctgtttattatcattattttattattattaaaaaaggaagtctctcagaaaccaagctgtatatcctctagtctctatgtaaaaaaacaaattggtcattttctacttggacatcccagaatagaaagtacattgaagtactaaaaaataaagggatagacttggggttaagggagatgtcatagaacagctatcctgggttagttcaagtgtagtcctattccatgctaggcaaagtcaaggttacaaaaatcccagttgcatcaggtttccattttttatcattatttccctatacaacgatacaagttaaaaaaaagtcggtaaatacttttggccatcaattttcaagatttcattggtgatattaaggaaatgctgtaagtaggtaacacataatgtcatatttgtgtgctgtagaagtatcttggaaaatatggactttaaaacctcaaaatatgggtttgcaatcgaacatacattcacccccaaatttgacctttttcagctagttattttctcatataaagttactatacttacaccattatctttaatccctgaaatttcaattatactagaaatcaagattcttcatttttactcacgaaactgacactaagtatatacctcattaaggacaagaagctatgaattctctggacttcagttatctcacagaaaagagcttgattgaataatgtctaaggctcttcctgacatagtctaaataacagaaggtgtctcacaagaaatggaagcagtgagagaaaaatgcaattaaatcctagactagaaagaatcacaattttcccactcacaggttggaaatgcctctctattctatcacaattttgaaaacctccatagttttactagctttgcctttctcccttgctatcatcttctgaggtacagacagtcctttccatttttattcctctcccactctgataatttttttctttgacagaagtcccactttatcattaatgatgacaataactaaggctgccaggaacagcacatctgctgagctttatcaacaccagattctctcattttgccttctggatctccatgcttttttataccaacaaacaagaggaagaatattctctacccacttccttgactgaagcctgctcttttatgaagacatggcatctcttccaaccgtgtcaaacagatgcaatttatatgtctgctgcttccataccctgattaaatgggtcagtggcagaatcaagcatttgtttgccagtaagccaggtgccatgttgtcatacagccctaaatagagaagtccatgtgagtttggccttctgaggcctgtcaaaagacacatgagtgagctcagaagtggaagcttcctcattcaagtcttgagaggactgcagcccagccaacatcctggttgccactacatgacaggcttgagccagaatcaagcagctaagctgcttctggattcctgacctacagacactataaatcaggaatgtttggcttccaactgctaaatttggggataatttgttatgcaaatataggtaactaatgtatatcccatggattccacgcccattgttataataatttacttacaacagtcttcagctatttaacatttttctggctggatcaccacgtttactgtgatgaacaactgcccttcctgatccaggacccatgcagcagagcattactgaagaaattcacaccctcaggcagttagatgtccctgtaaagttatagtcaccaggttctcatgatctcaccacacagactgttacttataagctccctctcttattacaccctatgaatattttgtaacttttctctgattattaaaaatgcttctcctcaactcttgaatgataagtgataaccttttttcattcattatttataaaacagatgtgattagatggaaaatatcttatattcatt

SEQ ID NO: 813 - DNA, 297 bp, Homo sapiens
gccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtct

SEQ ID NO: 814 - DNA, 299 bp, Homo sapiens
ccgccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtct

SEQ ID NO: 815 - DNA, 2638 bp, Homo sapiens
tcccttgcaccaaaaacagaaaggaaggcctatgaaaatcagaccatgaagtcttatttttcattctttggtctagtaatttaatttcattttccagattattaatgctgcagtttattatatatttgatgctgaattgctgaatttgacttgtccaaatgacatcaatcctgcctttatctcattgccagaagtagtgaatatattgctttttatcctggtgaaagggaagattcaaagttgtttgaaggagaggggctgatctgtgtggtggcagtagaacatattctgattgatgtcctctaaccttgcaaacttgccagagcatccacctagttcaaccctagttcagttatcatggtggaaacccattatgggcactcttagcaactattgtgcctatatattaataagtctactgaataacaattagttcatccccttacttcttcagcccttacttccacattgaaagaagtaaaaagtagaactcaccaattgctatttaagcacatttgctagttttgtaaagtctatagacttctaagaggaatatatgaaacctcaagtaaatatattaaaacatgcacaaaataaatatatttatgatatatactttttattgtaactatcaaattttaatcaaaaaatttgtaatgctagggaaatctcaggttttactaatggaattatgaaaaaatattaatcttaatacaatttgtaaaatgccttaaaagttagatgttgaaatggacttccaggtcctgtagctacttctattgaaattatcatcataatgttttacaaaatgagaaaagtaatacagtttctctttccagttgccctgaagcagactaactgatgcttgtaaagatgtttctcagcataaatggattgttagagaatgaacttcagttaattttgaccttaaaaaaaagtcacgtagatatgtattttcatctgaaacattttcaagagtcttgcaaacaagtcactctaaaataatttatgacaatgtttatgtgctcaattacattttggtttttcaatacatattcttaccttaagtgaaagtagattgtatccctggttttcatttttcagcacattttcaagttttctaagagaagtacaaaatcataatctgtcactacataacatgtcactacatgttcaacatttgtaaaactcaatttattataaatcctgagttattagtaactgttatttgaaagccattttagtaatcatagaaagcactaatattaaggagtaaaaaatcaacaattaatatcagaaataaaccatgagctcttagaaactagtgggataccattaggcattcataagatataataattcaaaagtaaaaattatatgctttgtagctcaaaagtgctttcacctattttctcatttgtgtagccttgaaatagtggtagatgagtatttcaaattcaagcatcagatatttcataaatactgcatatgcctgtgtgtggaattattgatgttttgaacctataaacaggatagaaaggaagagatggtcaggaaacaatactggagaagaaaaagaggtaaatggtaaaagcagaaaaaatgattagattatgtttattttagaatagattcatttagtgaatatgaattgaggaacctacttaatgccaggcactatttgcagctctggatgtacagcaatgaacaaaacttttaagtcatgcccacaagataaagtgaccaactcatctcagtttgcacagatgttcctggttttagtactgaaagccctgcattccagaaaccccttagtcgagggcaaatcaagacggttgctcaccattatcagaacctcactttctggtaactgtcatcttgatttccaaattcatattaatatttttatctcattgttaatgacaatgcaagttagcactgaccacaagtaaccaatggctagtatacctgtttctaactggggcaaagttatgacaagagcaaattatagtaatatcaaacttcctagaattatttctagacaacactccttggagtgcaactgaagtatcaaaagtacaacttgccctcaaggaagagttagtgtctgggaatgtgaacgaacaatcataaccaccatttgcaagacacctacgtatatcatctctagttcttacaaagccctctaaggtagtatcatcatctccgttgcaaggataaagactttgagagtaaactctcccatacacaataatgagaaagaaaacccaaggtaaaagaagagaattggagctttcagatggctatagcaagtcttgtataagcaatagcatttatttttcagaacagaaaactattaatgctctcagtgtattttacttcttgtgttctattggattatattttcctggaaactggcttctctttggggtcacattttggtaatcaatgttagtcttattcttgttcagtcaagtttactaatgaaatggataggacagtacctttgaagcactgacttggttaatgtggcaatgtttgaactatttttatattgactattattgaatttcgtagaggaacttcaaattgaagacgttatggatcagccagcattcaaagatgaaaataaatcaat

SEQ ID NO: 816 - DNA, 1353 bp, Homo sapiens
aataattgcaaatatatttattacaatttacagattagttatgttatatacacaaatataattttaactataaaatcccaactagttacatttaaattattgatctgtagaagccaatttagagtcttctagtcccctaactttaccttccttaaattatacaaaaataaaatctgatagttttgatttcaagttaaagatgaagaagtgttacatttcatcactcagaaatggaacttttacctgtctgtacaaagccttttacatgctacattgacacttaaagcaccattaacaagactttaaatgtataaaatgtttaattaaaacctccaaagattttctctttaagattacgggggtttaactttgttctaactagaattgggatgaaacaagaattttgcttttttctccttcagtccaactttaaaatagtcctttctgtccttcttatcaccttctgatcacttcttccaaggaggctagtatatggaagaactcttaatcaagctttcactcatttggtagtgaggttagaatcccatggggaacaattttccaaaatccaatgaaagatgtctcattattttcaaatacacagaggtgctaggtttaagaaacaggaaacacaacgttaagtctcggaaataaaatgtttcagcctggttttaaaagaatgcctgtatgttgtcaaaaggcttttttcaaggcaaatgacgcctgctttccaaccgacattgctgttgcttgaaactagcctgttttcatgttattagaccatcctgtaaatgtgctccctatgattacctaaagtggaggtgcacaaaacacacagaatcccagcactttgagaggccgaggcgggcggatcacgaggtcagcagttcaagaccagtctggccaacatagcgaaaccccgtctctactaaaaagacacaaaaaattagccgggcgtggtggtgtgtgcctgtaatcccagctactcgggaggctgaggcaggagaatcgcgtgaacccaggaggcggaggttgcagtgagccgagatcgcgccactgcactccaagctgggggaccgaacgagactctgtctcaaaaaaaaaagaaaaaaacaaaaaacacacagaataagggctctgcaaaaatttgaccagcttttatagtgttgcattctcaatgtgtttaattatgaatatataaacagtggaggcagttcttagaactggatagaaataaaataatgaccaggtagattgtaaactgaggtagtaaccctgtaagcacttctgatgaaaaattcatccccacacttaaataagttcaaaactaagaggtcacctattctacttatg

SEQ ID NO: 817 - DNA, 2284 bp, Homo sapiens
gctattggctaaggagggcttatcggctgggaccccttgtatgcggaaggccggggacagggagctaggcggaggctgtggtcgaggccggagagcgccctgcggggggcctgcggagacggcgcccgcattttcccagctctgggtgcgatcgactgctcctgccggtccagcagcgcccgaggcggcccctgccttggccccaggttctcccacttgccccggtctctccctccccagactgggcgccgctgcagtggtctcagctgcgtgaaattccttcaagccccctcttcccgcctccacccacgctgccttccagctattcattcacgagaatttcttgaatgcccacactaggcgctgagctgataaactggggtccgtggcctggaaccctgctgagtgtccctggcggccttgccacagggtgcaaatcgcgttgaagagtggaccaagggctacttgaaaaggcggttgcggagaaagaaaatagctttgataataagaattagtagtttaggcaagtctttgagcctatcaagtaattcatcaagaggagaagataagttattttgagaagcgaagccagaaaaataacacaggtccttgacgctggtgttcgtcctcggataatagggctgctttggagacaggcaacagtagactggtagaatcgttctattgcttaaggctttgatggtggaagagaaaaaacactcttgttgaagtggcatatccaagaacagtgctttctttctggtttaggatggagaaggaactgactgctgtacccaagtgaagatctttactcagttacccttatatttggctatatggaataaaattgtgtgatatgtttattctgagcaggtacaaaacttcagcaaacctattggtcccacattttcccccccatttatcatatgatttggagtgaccggttgacctttgagttaatgaataatttaaagcagtgaaaaattttttgcagtaaactacggtgttttaaccttgataacataagcatagtggttaagattctaggctttgtatctgaacatacccagagtcacatccatttacatctttgattttgggcaagttatttaatctctctgcctcagttctcttgtctctaaattggggataaaaatgttttcctgataacagtacctttacgtgtaatggttcatgtatcgtatttattacagtgcctgttttatggtaaatattcaatacatattagctgtttttataattaattcctcccactacatcatgatccaaactgactcttttcttaagtgatggggaagggaactgaatattttaaggaagtagctataaaatatgatttcaagttgttctgtagtaattttggtgttccataaggacattttaatgtgaaaaagatactgacagaatctatacatggtttgaatttattagtttctaaactatgaccagtattagcagatttaaaattcataattatagcaagaaaacgtcaaagttgtttaacagtgttaaaatttgaaactgtaatgatccagaaaaatgaaataccaaaccgataattttgggaaaaaaacaaaacttgagtggcattatgcaggccatttactttttaaatgtactcaatataaacaggaatcccttctctccaaatttcagtttttcagaatttgggctgtcatttgaaacacttactttgggcactttgactgttaaagaagcaaagggtatgctaagaacttcaatgagtcttgatgttagtgtttttgtaattaggtggaatctcctaccttttcatgaaaactgggtttaaagcagtagctgctgggtccattctaatgataatctcaaaaatgtgactgacttgtaaaaatctacaattatttattaatgtgagactaggtaaagtatgagttgaaaaactaggaagaaaggcagagtggtgatttttaagcttgtataaaggaaggcccgctttgggtactatgaggtacctttctcactcagaggcatgctgtgaggatttgtgacttttaaatcatttagctctttttataactttgtggaattaaatctaccacgtatttcaagtgtattcaggatatgaattttcctggtagagagttttaacagatttttttctcttaacccttcattgatgaccaaacaattttgttgtctgtaataagaaagtactcggttttgtagggtgtcagtccttaagaaaatgttaggtagtcatcaataaaatagcaacaatctctgg

SEQ ID NO: 818 - DNA, 1707 bp, Homo sapiens
gcaacctccacctcccgggctcaagcaattctcatgccccagcctcctgagtagctgggattacaggcgcccaccaccacgcctggctaattttttttgttttgtattgtttttttttttttttagtagagatgagatttcaccatgttggccaggctggtcttcaacttctgatcttagctgatccacctgcctcagcctcccaaagtgctgggattatacgcctgagccaccgcacccagcctcaaatcataaacttttttttgttttttgagacgaagtctcactctgttgcccaggctggagtgaagtgacacaatcttggctcactgcaagctccgcctcccaggttcaagcgattctcctgcctcagcctccccagtagctgggattacaggtgtgcgccactgcgcctggctaattttttgtatttccagtagagatggggtttcaccatgttggccaggctggtcttgaattcctgacctcaggtcatccacccacctcggcctcccaaagtgctgggattacagacatgagccactgtgctcagcctcaaatcataaactttttaaaggtttatccctgaccctctaaattaggttatgtgccttgttatatgctcttttagcacttatcctaattgtgattgtgtatttattatatgattgtttattcaacagtttctttcaacaaatatttaccaagtgtttagtaaatcttgttttggattgtaagcttcattaaggcagagtaaggactgggtctgtggtttctcttaccatgtgtacctagcacctagcacagtgcttagacatagggagtacttaataaatagtcattgaatgtatacattaaaatggcgttaataatgctgcctatctgatgaggctgttgtgagccttcaatgaaatcgtgtgtaggaagtgctagtttgctcacaggctggtggtaacagtctactgtggtcattgagagcagttattgtggacacaacccccagttctggtcaccccacccactagctctgtgaactcacataggtacttaatatctctgatttttattttatttatttgtaaaatggaactaataattacaaccaccttataggacagagtcttgctctgtcacccaggctggagtgcagtggtgtgatctcatctcactgcaacctccgcctcccaggctgaggcaggagaatggcatgaacccgggaggcagagcttgcagtgagcccagatcgtgctactgtactccagcctgggtgacagagcaagactacatctcaaaagaaaaaaaaaaaaaagtattattgagaatataatataattaacctgaataggttaattatattgtggaacctaaaccgtataaatttaaaatgccttagaatgcccagtcagcaagtgacagtattagaaatcaacctggattttagaccgctgtgtgttcatggataatgtttgtgtgtttaggagactattctgaatagtggttcacagtcctttacatgcatcccctgtgcattggatgcttcactagccttttctgactaaagcatatgaaaatacaagtgaaaaaggcaagttattacaggaataacttttcattttctctaattttcatattttaaaaattcatttgtaagcatttgatactttaaacctgtttacaggaacttggtataaaccaccatgtccagcc

SEQ ID NO: 819 - DNA, 2023 bp, Homo sapiens
aagagtcacacatctctcacgttaaatcaaaagttagaaatgattgagcttagtgacaaaggcatgttgaaggccaaaacagaccaaaatctacgtttcttatgccaaacagttagccaagttgtgaatgcaaaggaaaagttcttgaaggaaattaaaaaggctacttcagtgaacacaggagtgataagaaagagaaacagccttgctgttgatgtggagaaagtttgagtggtctggatagaagatcaaatcacccacagcattccctaagccaagtcctaatccagaccaaggcagttactccgttcaattcagtgaaggctgagagaaatgaggaagctacagaagaaaagtttgcagccagcagagtttggttcttaagatctaaggaaagaagtaatgtccagaacagaaaagtgcaaggtgatgcagcaactggtaaggtagaagcttcagcaagttattcaggtatagctaagataattcatgaaggtgaacgaaggtggctacactaaacaacatattttcaatgtagaccaaacatccttctattggaggaaaatgccatctaggaatttaatagctaaagatgaaaaatcaatgcctgtttaaatcttcaaagaacagtctgactctctttttaggagctaatgtagctggtgactttaagttgaagccaatgttcattgactatcctgaaaattctaaggtccttattctcagcaaactatcgcaaggacaaaaaaccaaacaccacatgttctcactcataattgggaactgaacaatgaaacacatggacacaggaaggggaacatcacacaccagggactgttgtggtgggggcggggagggatagcattaggagatgtacctaatgctaaatgacgagttaatgggtgcagcacaccaacatggcacatgtatgcatatgtaacaaacctgcacgttgcgcacatgtaccctaaaacttaaagtataataaaaaaaaggaaataagctcaatctactctgcctgtgctctataaataaaataacaaagcttggatgtcagcacatttgtttacaacatagtttaccaaatactttaagcccactcttgagacctactgctcagaaaaaaagatttctttcaaaatatcactgctcattgacaatgcaccaagtcactcacataagagctctgatgaagatgtacaaggagattaatttaatgctgttttcatgactgctaacacagcatccattctgcagcccatgcttcaaagagtattttcaactttcaagtgttatgatttaagaaatatatttttatatatttatgaagtatagctgccatagatggtgattcctctgataaatctgggcaaaataaattgtaaacctaggattcaccatcctagatgtcattaagaacactgttgattgatgggaggaggtcaaaatataaacattaaaagaaatttggaagaagttgattctaaccaccatggatgaccttgccggattcaagaattcaatggaagaagtaactgcagatgtgttggaaataataaaagaactagaattagaagtggcgcctcaagaagtgactacattgctgcaatctcatgacaaaagttgaatgaatgagaagttgcttatagataagtgaagtggtttcttgagatggaatctacacctgataaagatgctatgaatattgttgaactggcaacaaaagatttggactattacataaacttatttaatgaagcagaagcagaggcagtgtttaagaagactgacttcatttagaagttctaccatgtgtaaaatgccatgaaatagcatcataagctacagatacatttttctgaaggaagagtaaattgatgtggccaacttccttgttgtcctattctaacaaattgccacagtcaccccaacttacagcaaccacccttctggtcagacagcagtcatcaacatcaaagcaagacctcccaccagcaaaaagtatcactagttgaaggctcag

SEQ ID NO: 820 - DNA, 1527 bp, Homo sapiens
acatataaatgattctaaggccttctgacctgtctttcaataggatggtattacccaacaattatgacgtctacacatacttttcattttcaatcacattgggacaaatttttatctttatctcatttctgctttctcctgtatgtataagtgctgatattttactgctctctacaaagagtaaagtctattatggtcttacaacttaaatttgattccaagacaaaggttaattggtaaagattatttcccaagcgttaatattgtacatgaatcagaaggtcagatggcatttctggatctgacagctcttatcataatgaaggtttgaaagaaatgtcatcttgcgtactaattaatggttttagccctagtgagagatcttttatttaacgccagtaagttaatcgcagttgatgtctgtgaactgtcaactctcaagctatgcatctatttgaggtcattgctgacaaaacccctattttacaggcaagatcactgaatatacatcacttgccaatgtatcatagacatttgaaaacttatagaattcagcaaatattgttcattttatttactcattttttaatagtaattacaaactatgaatggaaaaagctataatttaatcattggactacatacattcaatttttaaaaaagactctgctaaatagaaaagtgtttgaagtatttatttttccctaagtaaaaaagtaattttgtgagacagtcacaattataatcctgatttctaaaatttattaatttgagatcttcattagaagaattgagacattttttcttctgaaaacaagacacatacacaaatatatatatatatatgaaaaacttccaatatttaagaagtatttcctctgaacattcttagttacaaatgctattttaaatttttaatatttgctactgataatctgagagtgtcacatttattatcctgtttcagccgtaagtgaataagtgttactgcattttagcagaactttatttacgaaaacaggctagatttggccaaggttcatagtttcctgaccacagttcttaaacatagcaaaaggtatacaaggtaaactcacattttctagatgaccaatcacccaggtttccaggacaaggaaatgtttgttagtttaagaagcagggcaatcctagacaaactggattagttggttactttactttttcctagattctaatatcatttgttcattcaataattcatttaacactgagggtctatcaacattcaacaaacgcaaagtttcaaattaaaacaaaagcacttacatgttctgccattatcagacaattatatgacatgttattttgcagccaattgtaaaaggcatttttttactttattattaattttaaatttagacataccttaaaatggacatactatagtaaacatcaacataaaacaagataatggaatattattcaaataaaaagatacaatatagcaatataaacttttttgaatttatgtcctatagaagttct

SEQ ID NO: 821 - DNA, 2409 bp, Homo sapiens
ttgtcaattatattgacaaggtttgggtgtgtatgtcatatttaaattataagggaaacagtgattatatatttgtcttaaattatagtacttaggaaacagagtgaagaaaaaggaaaaaaaaaaaaaaaacctaagtggcagggaccctctgtttttgaaaacatatttgtatattcaatatgccaaaatatctaatattaaagtgatatactaataaatatatttggcatattattatggtactttcagttctcaaacttttaaagtaaaaatattgatcaagattaatgttcccaatgcaaagaaataataaatgtttgaggtgatggacatcccaattaccctgatttgatcattatatattatatgcttgtatcaaaacatcacatgtaccccataaatatgtacaacaactatgtacctataaatattgaaaataaataattttttaaaaagaaaattctgaatttgagattttaaaatcaaattcaaggtataatactggtcaaaaattgtgaaccaaatatgttattttagtttttttattgctgtggtaacaaattaaaacaaacttagccacttaaaataacacccatttattatcttccagtttttatgattccaaagtgttggctcagcatggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggcaaaagtactcatacttcaaatctctttgttctctgctgaatctgtctacatttaaagactcatgatattacattgagcccacctggataatccaggataacctccctattttagaacaatcttcactgcctctgcaattttttttttttttttgccatgtaatataacatagccatagggatgacaccaaggggtgaatgagggttatggggctcaaaattctgtctaccacatatgatggagctcttcattttcctctcacattatgagattctctattaagtgttcagtttaattattcttttagatattaaattttaaaggtaagaccaaattaactttttaatataaatgataaaagtttacaaatatccaactatctgttacccaaaaattaatctttcagagtaaaaagaatttagttatggaaataataaattgaaaagttacctttcgccagtgtctttgtttctggtttttcttttttctcaattttttccttgtgagttgcttaaacagaaaattttacattagtacacatttttaatagatttcaaaaccaagctttcttttgacctcagtttcataagtgctaaaacctaatctgtaatattttgaaaatgtatgacattaataagtctaattcagaaataaagagttaccagtgtaataacagttgtattgaattcaatgttaaagtctaggcattaagacttagcaagcttgttgaaaatcagatctactctttctcaagtcattatttcaaacaggtaaagctttcagggaagacaaactgaaagggaaaattttctataagaatttgtcaaaaaatatgtcattatgtgtatttttaaatttgaattatattaaattgtgttgtttggtagtttcccaaatcatcatacatttttcaatatttacatactattttttcaagaataacaatggtaattaaactacgaaaattaagtagtaaaatatgagatttaattgggcagttaacaaagtgtatgcactgatttgttagaggaaaaaattagttccacatatttccatttctcctacttccaacaagaatagtaataatgtacatcagctttacttacatcattaagaaatgcttaaaatatgtatttaaaaatccattatttttaaatacagttgataaacagtgtcctccagaatcttggagagatgatttaagcctcagaaagcctaatattcagttgaagagcaagtgtccctaacacatgcagagctgctgagagaccaggtgcctcctcctccagagtttcagcctctccaccactcaggcctgcccacaggtacctccactaccacttgggattatgggtaatagattagacaatgttaacaaaaggagcattatgctaggctaagcaaggcactattcaaacaaggtcacaggactacattataataacatatctcctaaaaagcaaacatcctttaattggcataaggtaaataaaagagcacttacaatgcagcattttatttctgcttttcaatttgaatacatttttttctgcagcacttataatttaagggcaaaaattcctaactttttttttaacagaaa

SEQ ID NO: 822 - DNA, 11890 bp, Homo sapiens
ggatcacctgaggtcaggagttcgagaccagcctggtcaacatggtgaaaccctgtctgtactaacaatactaaaatcagaggttgcttgcagtgagccaagatcataccattgcactccagcctgggcaacagagcgagactctgtctcaaaaaaaaaaaaaaagaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccaaagggaggcaggtctggacagagctgaagattgcacaggccatttgcaggctggattcgttctctggtgacccacctgtctgactcgaattatttttttcccatgtctggacaagactgacctctgcccagcaactgaggcctggatttagtccaagggccctcagtggcttttttgtttgtttgttttttcaggaagtgaagaatttagagggataaaaggcggaaataacttttcagcctctgacctttgtaacaatctggtttccttttaaaggagcattgtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggacagaaacaagatggtaagatagagaaggaagagtggcctgctcagatggggtggtccagaggcctctcgggggaggtgactcctttttgttttattttttttgagatggaatctagctctgtcgcccagcctgaagtgcggtcgtgtgtttcatgcgcgtccgtgtgaagagaccactaaacaggctttgtgtgagcaacatggctgtttatttcacctgggtgcaggcgggctgagtccgaaaagagagtcagcaaagggtggtggattatcattagttcttacaggttttgggatagggggtgaagagccatgtttgcaggcaggggtggatctcacaaagtacattctcaagggtggggagaattacaaagaaccttcttaagggttggggagattacaaagtaccttcttaagggtgggggagattacaaagtacattgaacagttagggtggggcagaaacaaatcacaatggtggaatgtcatcagttaaggctatttttacttcttgtgtggatcttcagttacttcaggccatctggatgtatacgtgcaagtcacaggggatgcaatggcttggcttgggctcagaggcctgacagtgtgatcttggctcactgcaaactctgcctcctgggttcaagcaatttttgtgcctcagcttcccgagtagctgggattacaggtgcccgccaccatgcccagctaatttttgtatttttagtagagacatagagtttcaccagattggccaggctggtctcgaactcctgtctcacgtgtctgtgtgaagagaccaccaaacatgctttgtgtgagcaacatggctgtttatttcacctgggtgcaggcgggctgagtccaaaaaaggagtcagcaaagggtggtgtgattatcactggttcttataggtttggggataggcggtggagttaagagcagtgttttgggggcaggaggtggatctcataaagtacattgtcaagggtgaggagaattacaaagaaacttcttaagggtgggggagatgataaagaaccttcttaagagtggggcagattacaaagtacattgatcagttagggtggggcagaaacaaatgacaatggtggaatgtcttcagttaaggctgttttcacttctgtggatcttcagttgcttcaggccatctggatgtatacgtgcaggtcactgggatatgatggcttagcttggactcagaggcctgacattcctgtcttcttatgttaataagaaaaataaaacaaaatagtggtaaagtgttggggtggcgaaaatttgtgggggtgatatggagagataatgggcgatgtttctcagggctgcttcgagcgggattaggggcggcctgggaacctacagtgggagagattcaactgaagaaagattttggggtaagggctgatactgtggggttgttagaaggagcatttgtcatatagaattattggtgatggcctgaatacggttttgtatgaattgagaaactaaacagaagacacacagtccgaataagagaaggagaaaaacaggtattaaaggactaagaattgggaggacccaggacatccaattaagagagtgcccaagggggttcagcataattatttgcttggttggcaagtttttggactctatccttgagtttttttatgttgtcatataccaggccagattgatttaggtaaaaacaacactcttcatttaaaaatatacagagtcgtcctttttcagcaatgagtaaattgaggccttggcgattttggaggaaagagaattgcaaagccagcaattgtttctttttttatttatttatttacttattttttaaaattatactttaagttatagggtacatgtacacaatgtgcaggtttgttacatatgtatacatgtgccatgttggtgtactgcacccattaactcgtcatttacattaggtgtatctcctactgctatcccttccccctcccccaccacacaagaggccccagtgtgtgatgttccccttcctgtgtccaagtgttctcattgttcaattcgcatctgtgagtgagaacatgcggtgtttggttttttgtccttgtgatagtttgctgagagtgatcgtttccagcttcatccatgtctctacaaaggacatgaactcatccttttttatggctgcatagtactccatggtgtatctgtgccacattttcttaatccagtctatcattgatggacatttgtgttggttccaagtcttcactatcgtgaatattgccgcgataaacatatgtgtgcatgtgtctttatagcagcatgatttataatcctttgggtatgtatccagtaatgggatggctgggtcaaatggtatttctagttctagatccctgaggaatcgccacactgtcttccacaatggttgaaccagtttacagtcctaccaacagtgtaaaagtgttcctatttctccacatcctctccagcacctgttgtttcctgactttttaatgatcgccattctaactggtgtgagatgatatctcattgcggttttgatttgcatttctctgatggccagtgatgatgagcattttttcatgtgtctgttggctgcataaatgtcttcttttgagaagtgtctgttcatatgctttgcccactttttgatggggtttgtttttttttcttgtaaatttgttggtgttctttgtagattctggatattagccttttgtcagataagtagatggcaaaaattttctcccattctctaggttgcctgttcacactgatcctagtttcttttgctgtgcagaagctctttagtttaattagatcccatttgtcagttttggcttctgttgccattgcttttggtgttttagacatgaagtccttgcccatccctatgtcctgaatggtattgcctaggttttcttctagggtttttatggctttaggtctaacatttaagtctttaatccatcttgaattaatttttgtataaggtgtaaggaagggatccagtttcagctttctacatagggctagccagttttcccagcactatttattaagtagggaatcctttctgcatttcttgtttttgtcaggtttgtcaaagatcagatggttgtagatgtgtggtattatttctgagggctctgttctgttccattggtctatatgtctgtttcggtagcagtaccaggctgttttggttactgtagccttgtagtatagtttgaagtcaggtagcatgatgcctccagctttgttcattgggcttaggattgtcttggcaatgtgggctcttttttggttccatatgaacattaaagtagtcttttgcaactctcatcagcccagtttaatattacctatttattataatgtaatgctgctcggacaactgagaaaatactgttgctttaccccctccagctctgtagcagccacgcagaaatcatagaactgtaaacatatgctaattacacaacctatgtaggcaatcaatattaagaaaaatttttactgctcggtatttctgtggttgaaaatgtagagtctaattttgatccgcagtaacatctaggttaatgttgattcagaaggaaaacgtttgttgttgccatgagaagaggcattgaaatgctgaatcaccaccacaaatgttaccactattaatataaggagatacataggaagatggaattagaccatctcggaccaccaggtttacaattccacctgcagatacatgcaagaagtattgtcacaatacttatgtcacgttattccgttgaggtcatcaccaactaagcttataattaatgtgtggtcaatttggtcaatgtcaccagcgtagcatactaacaaaaacaagggttgcaaagtcaaatgcctataaggcagaacgtaagacggtaggaagcaaagtctatagggagctatataatagaggctgcagattcatggcagattctaaagcacagcagtccccaacatttttggcaccagggaccggctttgtggaagacaatttttccacaggcggcaagggatggggcgcaggatggtaatggtcttgggatgaaactgttccaccacaaatcatcaggaattagattctcataaggaatatgcaacctggatccctcgtgtgtgcaattcacaacagggttcatgctcctgtaagaatctaatgatgctgctgatctgacaggaggcagagctcaggcagcaatgcaagcaatggggagcagccagaaatacagacgaagcttcaattgttacccaccattcacctcctgctctgtggcccagttcctaacaggccacagaccagtacatgtccatggcccaggggtcagggaccctgctgtggcacattgcttaatagaggactgtagcagccatgtgccctgacctttcctttttttttttttttttttttttttgagatgccagaaacccagaatttttttttttttttttttttttaagacaaggtctggctctgttgcccaggttggagtgtaggagggcgatctcagctcactgtaacatcaacctcccaggctcaagcaatcctctcacttcagcctcccacgttgctgggattacaggcacactccactacacccagctaatttttttgtattatttgtagacatggggtttcgccatgttgcccaggctagtctggaattcctgaggtcaagctgtctgcccatctcagcctcccaaagtgctgggattgcaggagtgcaccaccacacctggcctgaaacccagattttatttatttatttattcattttttgagatggagtcttgctctattgcctaagcttgagtgcagtggcgcgatcttggctcactgcaacctccacctccctggttcaagcgattctcctgcctcagcctcccaaagtgctgggattacaggcatgcaacaccacacccagcctgaaacccagatttttaatatgaaatcaaagtcttcagaccttgtaggtgtcataaaaagcacgctgaggaccactagtttgcaactgccaatctaaaatatcatagacattatatcactttaaccacgaaaaaaaaagtatgtgaggcagaaaatggaagcaaccatgcctaatttattgttgaatactttttccgtataccaagagcttcctttgcactagcatctgaaactatatccagaatgacactggttttcataaaagtgttgatcctcacacctctttatagtcttgcacctagcccagtggagtgaaacactttaaatagcacttgttccttgagtatatatggaaaaaagtgaagtattgataagtgctcagctaatatgagcagcatctcaggagtctccaattcttgaattaccagggagtatttttaccattttcccccagtgaaaggcctattttgagagacttatcctccaaaatgaatgtattaagtcatgttccttttttttttttttttttgagacagggccttgctctgttgcccaggctggagtgcagtagcatgatagttacaggaaaggggtcccaatctagaccccaagagagggttcttggatcttgtgcaagaaagaattcagggtgatgccacagtgtgaagtgaaagcaagtttattaagaaagtaaaggaggaggggcaccgtggctcactcctgtaatcgcagcactttgggaggccgagacaggtggatcacgaggtcaggagatcaagaccatcctggttaacacggtgaaacctcatctctactaaaaatacaaaaaaattagccaagtgtggtggccggtgcctgtagtcccacctactctggaggctgaggcaggagaatgggatgaacccgggaggcgaagcttgcagtaagccgagatcgcgccactgcactccagcctgggtgacagagggagactccatctcaaaaaaaaagagagaaagtaaaggaataaaagaatggctaccccatagacggagcagccgtgagggctgctggttgcccatttttatggttatttcttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcctggctcctatttaagatggagttgctctggttcacacacctctgacatgatcattgcccactgcggcttccacctcccgggttcaagagatcctcctgcctcaccctcccaaggtgctgggactacaggtgtgtgccaccacgctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaatcattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttattaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaatttccagacttcctttctgcattaaccagtttaactagacagtaacgaaatattcctactttatgctgtgatagtttgtttatttatttatttatttatttatttgagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacggagcgagactccgcctcattaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaaatgcatttcataatgcattttaattgcattagcagtgatttaatttttttagatgttaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccttggaagagaaatagtaaacaaataaggtttgtagcaatgatgtatgagttagaaattgcagttccagatgatctctttattaaagagacgatctacacttaatttggtcaagtgttatgaacatagttcatgttaagtctccatttaaatacaacctgaaataccaaagttaattttcttttctttctttctttttttttttttttttttagaaggagtcttgctctgttgcccttcctggagtgcagtgacgtgatcttggctcactgcaacctccacctcctgggcttgagcgatcctactgcctcagccccccaagtagctgggaggacaggcgcaagccacggcactcagctaatttttgtatttttcgtagagatagggtttcaccatgttgcccaatttggtctcgaactcctgagctcaagtgatccgcccgccttggcctcccaaagtgctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccaccgcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttttccattgtattaactgcttttacaacaacacaaataacaagttattttacaaaccatttagaaatttctgtactatggtcccagtaatgtaaaatatattaatgcctattacattcagataaattatacacttggaaaccacatacttatgacttacagaaatttacataaacaaattatagaaattatatgctcaatttttaggtatatagtcttaaattaagcttaaatatacattctcaagataaattaacagttcagggcttcacaacttgaaatctgtggaagatgacattggagacaacagaactctggtggaattcttagatggaatttgccgaaactttttttttttttt

SEQ ID NO: 823 - DNA, 2840 bp, Homo sapiens
gttttgcttttactcctcctagaagcaatggaaccttgcctgttccctgggggtgagacggatgactgcccctacattagctacctaacatttttgcttctccggacagaagagtaagggcaaggggacaagacccatctccccaaagcagctgatccccacttgcacaccaaactaccaatgaagctagccatttctggtctcccatcctgacttttctgagcacatggtgaagatctgtggaaaacattttgatgaagagagagtccttggaaggtgtcatcaggtattgaccaaacaagccactgtcctggatttgcctgtttttccggttccaaggccattcttctgccttgagtggttccttgagactctttatcatcttgaccttcccagaagagagctccacaaagagcacatcagtttgtgtgcttgaactaccgtagatgttatattggtgggcttcagtaaaggatggttgaaatgccagatcagatatgtgcagatttgtgtaaatatcaaaagcctcctgtatttctcctctgatggtaatgtactgaacccttacaagacctttcacatcattaatgctgacaaggtagtggccatctggagagacatatggagtgcccgtcacatcactattgaacccaatgactgagtcagttacaccgtccaccatgacctgtggggaaactgctccggtgctgtcaggtttgcagccaatgaagtagtagcctcccaagtgtgtatatgccaatgactgaggaacgcacttatagtccttcaagttaattgtcttgatgtatgacatggtttcaagatcaattttttgtagtgcagcttcatctttatgaagaataaatccaaacctgaaaaaaatgaaaatcagagttagacaggaagcaatggagtttttagccgtaagaaaaaaactagatacaggtggaaaggtccatcgcaggctctaattgtcaggcgaggcagcaatttgtgttacaattgtgctagaattaatctgtagattgtgccactctccttctttctctaggtcattctttcattacatccaaatcatcataactcatgctgtagaaagaaaaataattaaaagcaatacatctagttaattgcagcaacaaattttgcttttaacatagtggaaagaagaagtatacattattctgtaagtctctagaccatgtaatattaaataagcttggttaactattgccaaacccagcaagagtaaaaggctcgaatatatattggtttcactcatttcatttacttcttatattgttttttgaccattaaataaatctgacactcatcattatttagataaatttaagtataacatttttcaacctttcaatgtttatatgttatttttaatgatatgcctgcattttatttgttatcctatactgaataatgaagaactttatttttatattaaagccaattaaacaattgtttgtttgttttgttgaccttaaattagttcagaacttttcaaagcatatttgctaaatattgcttgagaattatcagagatacctgtggcaagtataaatatatttttaaactcacctagaacacaagcaactttctagcaaaaataagttaaacaagatacaatgagatagaaactattaaacaaaattaaacaaaattatatccaaagtagatattggccaatagaattgtaaaggacttttatttatgtttgcattaacaatattgattgtcaccttctaatagttctaaaagctcataataaaaataagagaaatatttttccattcactgtgttcataagtaatacaatgaaattaccttattatgagtattaagataaagcaaaacaaaaactctaaagagagccaattatgttatcatcacctgtgtaattatctttatgctaattatcacacataattatgacatgtagttttatttatgtaaaaaatgaccatttctacacatagtacaaaatatggtgcaatcagagtaatatctctttaaaattttaaatgtcagcatttagcaagctcaaaaatataaataaacatatattaaatatcatagaaaaataaaatattctcaaaatcagtcccgttttgcaattgcagaagaaagggagtgcctacacacagatgttttacgaaaatagacataaaattgtaattgtttccattcttcttacattaaatatagttgacaaaccatattataattttagctacatttaaaatttatgaggagactatttgctgtcattggagagagtacaaattcttctatatgaatgaaaattcacagtgtatagctactcctttataaaactttcttaaatatttgttaaacaactactaaatgcaaggcactgggaatatattgcagatcaacataactctccctgtctccaatgagtctagacattttgagtgataaaaaagtgaaacagggctagtgaataaagcttgattatagcattctgctatactattacctaattttgtaactatttcttgttccatgtatttgaaatggcataaagcaatatatttgaaaataatattttgagtgtatttctgaatgatgcccaccacttgtagcttatttgctaactgtttatcttttctgtgtccttaataaatgtgtttgtgtcctttcagtaaacccagctcataccatacccattcaggataaatttcagtcttgattatgatggtatgaagaaacattcatactgttgataattacttatattttcattaaaatattaatgccttgtgtgtaaacatagtgtagttttaaaatcctatctgaat

SEQ ID NO: 824 - DNA, 1430 bp, Homo sapiens
gtttttggtggttcttacagacttgagatggggcttgtcttaaggaaacaaggtgccctgaatctaaagactgactaaaggtggtagaacttaagctatttaggtgatcctgaaaccaacagggacagttatggtattgactagtgggaacttttaagagccataagactggagaagtcaaatgctgaccaattatatcaaacccacctggggaacaaactaagtcaaaattactagggtggctaaaagctgagaaatgaactaggtggcagttaggactgctgaacaaacccatctcaccatagcagagaaatattagaatacacctagagccatgtaaagattcaggagtgctaaaagcatgaattcccctccttccctccaccacccccaaaataagcttctgcctgaatgaaggtaactgggaatctgcaatttttttctttcctgcacaaataaccacttccccttattcaaataaaataaaggatatatctagaaatctgatcatttttaaatatttccagaagtggtctagtttagaactaaggctggttagaccggggcaatgttccaggagtacagaaaggatcttccagggtcttctagataaggaatgtccttcaaatttctacaagaaagtctgcagcatactgcctttcaagattaatggacaggatgatttggttatggttttacttgatgggtggacgtaagttccactaagaggtagactttccactaagatcaaagcttctgttatctaatttataattctaagttagctggggctctgtactaataagattttgaaagacttagtacccacatatcacaattaagctactctcttcctagtatgcagataacaatcaagataatactcagaaattctgtcaaggcttggcactagtcaaaaggattaaggatgtatacagggagaagcatatgtaggcagtgcgataaagataaaaagccatgttgcaacagtaaactggtatcttctgggactaaggacagcatattaacagctaaatgtacttcactctgcttagagctttagtaatacttcagatattgttatagagcagaaaaacaaaaactgccttatttgtgaccttctataattgccctacccaaaattaaaatgaccaaccattacaaacttaaaaggccatcatacatggtatttttaacttctgtatttccttctacaaatcttgtgaaatttttaacttacaagatcttgtcgttctgtcatgctcatcttctctactattgaccagaaccaacgcttgaactgcagaagcttctcagcattttctcctaagaatgaagaatgtaaataaaatatactataccagttgttgttattatctgtagaatattactaatcttcttataataaaaggatacagattaaaacatta

SEQ ID NO: 825 - DNA, 8928 bp, Homo sapiens
aatttcaccatcctcacctccccacagcacatctgaggcccatctggagaatggttaccagaggctgggaagggtagtgggagattgaggggaggtggggatagttgaactctcgtgagttcaattgttttcatttttagagcccacaaataactaagaacatgcaatgtttgtctttctgttcctggcttatttcgcttaacataatgatcttcagcttcatccatgaagtcctgcaacattttcggtgcccaatgtggggctcaaaaagcgaaagccatgttggttcaccacatgtatcgcatcctgataatgtgaagtgaaaaagtagagcctggaagcctttgtaagatgactgtgccagaggaggaagataaatatctcgatgctatggaggcctgtcagctctttgaagtatctgggcaatatcaagatttctacttcagatgaaaaaacaaatagttattcattgaccctgttgccgccaagaaagaggtgaaaggtgaacccccaacccacggaaagatccagccaagtaaggaactgcaaaatattgaatgactaattctccaaacaaggagaacaagaagatttatactagccatgcaaggaatctttggaagtctaacagacctgacttgaagagaaggctttaaacaagaaattcttcattctggaacagtgattcttaaagtgcggttcagagaccctgggagacactgacattctttcagagtgtgagtgaggatttcctctttgcaactacaatctgtgtaaggttggattttctttacatacataaactaaaataagattgcaataagatgaatgcagaagcagataagagaatccagctgtcttaagttagacttcacagagatttgcaaaaatccaaacaagaccactctcgtcattaaagttattttccatttgttatggtgaacttattttgcaggaaatttgttatttatagtaacatacaattttgttttttgatcattttaaataaattaataaatattataagttttctatttttaaaattatacatgtcagaaaagaacagttctttcaggtcctcaacaattttaagactattaacttgttttggatcaaaaagttctagatttgctattctagacatgaatcctttgaaattaattggcttcataagtatatttttcaagtttgtggcttgtcctgtaaccttctactgtgtagaagttttaaattttaatttaaagaaatttaaaattttttcatttttgtttgtgcttttggtgtcatatttaggaaatccttctctaccttgagttcatgaaaatatcctcttatatttagtatttacagtttgttcttcatctttaggtctataatttattgaaaatatagttttgtatgtgatgtaagctaaagatattttttaaaacttgatatggataacacattttggcaatattattcatccactcattctcccactgactttccctctgccacttacttacctacataagaatttgtcgtggagattctcttttctattcttttagtctaatggcttaattgttgatcaattaccctttttaactattgatgctttagagtaagtcttgatataaagccatgtaagtcccttgaattagtctcccacttttccttcttaaaaacattctgggatcttcttggcctttaactcctctgacttaattttaggatcaatttctcagattacattaacaacctgttcaaattgcatagattttataggtaaatctgtataaaatttacatgttataatattggggctttttattcataaacattttcaccaacgttttagtttcatatcttccaataagattttataatttttcatacctatcttagatgattttggttgcatttattttttatagttttagttttattgtcaatgcagctttttccaattcaattttataacagttttgctggttaaaaaaaaaaaaaagactatttattttgtgtattggtttttaaattgtacaatgtttctgaattttcttacttccaaacagtcgtctataaattatcttgattgtctaaaatgtgaaattcatatactatgagaatgataattttattttttcattttcaattcttaaacttctgatgacacttggctggaacctccttcactaggttgaaaataagtggcaacagtggtatccttgttctgttattgattccaagagcctgcctctaatgtttccccatgtattatgatgtttgtgtaaattttgatagaccttatttattaagtaaaaagattctcttctagttcaagtttggtctacaagtttttattgtgaaagtgaactgaattttagaaataccttttaatgtgtataaaaaattatatctttatttctgttaatgtgataaattacattaagagattttattaatatttggttatctttgtatttcaacaattatttggttatctttgtatttcaacaattatagtcatattattaaatattaatttggttagctaatattttatttttatgattttgacatctactttcataagtaactttatttttaactggttttactgccaaggttatactctcatagtaactgggggtttgttacataggtatacacgtgacatggtggtttgctgcacccatcaacctgtcatctacattaggtatttctcctagtgctatccctcccccttacctccaccccctcacaggaaccggtgtgtgatgttccattccctgtgtccatatgttctcgttgttcaactcccacttatgagaacatgtgtggtgtttggttttctgttcttgtgacagtttgctaagaatgatggtttctagcttcatccatgtccctgcaaaggacatgaactcatccttttttatggatgtataatattccatggtgtatatgtgccacattttctttacctagtctatcattgatgggcattcgggttggttccaagtctttgctattgtgaacagtgctgcaataaacatatgtgtgcatgtgtctttataatagaatggttcataatcctttatgtatatacccagtaatgggattgctgaggccaatggtgttcctggttctagatccttgaggaaccaccacactatcttccacaatggttgaactaattgatacttccaccaacagtgtaaaagcgttcctgtttctccatatcctctctagcatccattgtatcctgacttttaaatgatcaccattctaactggtgtgagatggtatctcattgtggttttgatttgtgtttctctaatgaccagtgatgatgagcttttcttcatgtttgttggctgcataatgtcttcttttgagaagtgctcattcatattctttgctcactttttgatggcattgtttttttcttgcaaatttgtttaagttctttgtagattctggatattagccctttgtcagatggatagattgcaaaatttttctcccaatcggcaggttgcctgttcactctgatgatagtttcttttgctgtgcagaagttctttagtttaattagatcccatttgtcaattttggcttttgtgcccattgcttttggtgttttagtcatgaagtctttgcccatgcctatgtcctgaatagtattgcctaggttttcttctacggtttttacggttttaggtcttgggtttacgtctttaatccatcttgagtgaatttctgtataaggtgtaaggaaggggtccagtttcagttttctgcatatggctagccagttttcccgacaccatttattaaatagggaatcctttccccattgattgtttttgtcaggtttgtcaaaggtcagatggttgtagatgtgtggtgttatttctgaggcctctattgtgttccattggtctatatatctgttttggtaccagtaccatgctgttttggttactgtagccttgtagtatggtttgaagtcaggtagcatgatgcctccagctttgttctttttgcttaggattgtcttggctatgcgggctctttttttgttccagatgaaacttaaagtagtttttttctaattctgtgaagaaagtcaatggtaacttgatggggatagcactgaatctgtaaattactttgggcagtatggccattttcacaatattgattcttcctatccatgatcatgggatgtttttccatttatttgtgtcctctctgatttccttgagcagtggtttgtagttctccttgaagaggtccttcacatccctcgtaggttgtattcctaggtattttattctctttgtagcaattgtgaatggaagtacactcataatttggctgtttttctgttattggtttataggaatgcttgtgatttttgcacattgattttgtatcctgagactttgctgaagttgcttatcagcttaaggagattttgggctgatatgatggggttttctaaatatacaatcatgtcatctgcaaacagagacaacttgacttcctcttttactatttgaataccctttatttctttctcttgcctgaacgccctggccagaacttcccatactatgttgaataggagtcgtaagagagggcatccttgtcttgtgccagttttcaaagggaattcttccagttattgcccattcagtatggtattggctgtgggtttgtcataaatagctcttattattttgagatatgtttcatcaatacctagattattgagaatttttagcatgaatgggtgttgaattttgacaaaggccttttctgcatctaatcatgtggtttttgtcattgattctgtttatgtgatggattatgtttattgatgtacgtatgttgaaccagccttgcatcccagggatgaagccgacttgattgtggtagataagctttttgatgtgctactggattcagtttgccagtattttgttgaggattttcgcaccaatgttcatcagggatattggcctgaaattttctttttttttttgttgtgtcttggtatcaggatgatgatggcctcataaaatgaggtagggaggattccctctttttctattgattggaatcgtttcagaaggaatggtaccagcttctcttcgtacctctggtagaatttgactgtgaatccatctggtcctggactttttgtggttggtaggctattaattagtgcctcaattttagaacttgtcgtctattcagggattcgacttcttcctggtttagactttggaggatgtatgtgtccaggaatttatccatttcttctagatttcctattttatttgtatagaggtgtttatagtattctcagatggtagtttgaatttccgtgggatcactggtgacatcccctttatcattttttattgcatctatttgattgttctctcttttcttctttcttcgtctggctagcagtgtatctattttgttgatcttttcaaaaaaccaggtaatggattcattgattttttagaagagttttttgtgtctctatttccttcagttctgctagcttttgaatttgtttgctcttacttctctagcacttttaattgtgatgttagagtgtaaattttagatcattcctgctttctattgtgtgcatttagtgctataaacttccctctggtactttgagtctgtgttctcattgctttcagagaatatttacccagtaagtcattcaggagcaggttgttcagtttccatgtagttgtgcagttttgagtgagtttcttaatcctgagttctaattggattgcactgtgatctcagagactgtttatgatttctgttcttttgcatttgctgaggagtgttttacttccaattatgtggtcactattagaataagtgtgatgtggtgctgagaagaatgtatattctgttgatttggggtggagagttctgtagaagtctattaggtctgcttgttccagagctgagttcaagtcaagtcctgaatatccttgttaattttctgtcatgttgatcagtctattattggcagtggtgtgttaaattgtgtgggagtctaagtctctttgtaggtctctaagaacttgctttatgaatccgggcgctcctgcattgggtgcatctatatttaagacagttagctgttcttgttacattgatccctttaccatatttaatgcccttcttcgtctcttttgatctttgttggtttaaagtctgttttatcagagactagaattgcaactcctgctttttttttttttttttttttttttttttttttttttttgctatttgcttggtaaatatccctccatccctttattttgagcctatgtgtgtctttgcacgtgagatgggtctcctgaacacagcacactgataggtcttgactctttatccaatttgccagtctgtgtcttttaactgggggcatttagcccatttacatttaaggttaatattgttatgtatgaatatgatcctgtcattgtgatgctagctggttattgtgcctgttagttgatgcagtttcttcatagtgttgatggcctttacaatttgttacgtttgtggtaccagttgttcttttccatgttcagtgcttccttcaggagctctggtaaggcaggcctggtggtgacaaaatctctcagcatttgcttgtctgtaaagaattttatttctctttcacttatgaagcttagtttggctggatatgaaattctggcttgaaaattcttttctttaagaatgtcgaatatgggcccccactctcttctggcttgcagggtttctgcagagggatccactgttagtctgatgggcttccctttgtgggtaacctgacctttctatctggctgcccttaacattttttcgttcatttcaacctttgtgaatctgatgattatgtgtcttggggttgctcttctcaaggagtatctttgtggtgttctctgtatttcctgaatttgaatgttggcctgtcttgctaggttggggaagttctcctggataatatcctgaagagtgttttccattctccccatcactttcaggtacaacaatcaaaggcagatttagtcttttcacatagtcccatatttcttggaggctttgtttgttcctttttattcttttctctctaatcttgtcttctcactttatttcattaagttgatcttcaatctctgatattgtttcttctgctttattgatttggctattgatacttgtgtatgcttcacgaaatttttgagctgtgtttttcagctccatcaggtcatttatgttgttatctaaactggttattcatgttagcaattcttctgaccttttttcaaggttcttagcttccttgcatttggttagaacatgctcttttagctcagaggagttcgttattacccaccttctgtcaattcgtcaaacttattctctgtccagttttgttcccttgctggtgaggaggtgtgatcctttggaggggaagaggcattctggtttttgaaattttcagccctttcgagctagtttctccccatcttcgtggatttatctaccattggtgtttgattttggtgaccttcggatggggtctctgagtggacgtcctttcttattgatgttaatgctattcctttctgtttgttaatttttcttctaacaatcagaaccctctgctgcaggtctgctggagttttctggaggtccactccagaccctatttgcctggatatcaccagcagaggctacagaacagcaaagattgctgcctgttccttcctctgaaaacttcatcccagaggggcacctgccagatgccagccagagctctcctttatgaagtgtcttttgtcccctactgggaggtgtctcccagtcaggagacgtggggtcgggacccacttgaggagtcagtctgttccttagcagagatcaaatgctgtgctgggagatctgctgctctcttcagagccatcaggcagggatgtttaagtctgcctaagctgcactcacagtgccccttgccccaggtgctctgtcccagggagatagataggagttttatctattagcccctgactggggctcctgccttttttttcacaaatgccctgcccagagaggaggaatctagaaaggcggtctggccacagcagacttgctgagctgttgtgggctctgcccagtttgaacttcctggtgactttatttacactgtgaaggtaaaacagcctactcaagcctcagtaatggcagacgcccctccccagctcgagcatctcaggtcaacctcagactgctgtgctggcagcgagaatttcaagccagtggatcttagcttgctgggttctgtgagtgtggcacctgcccagccagaccacttggccccctggcctcagccccctttccagggcagtgaatggttctgtcctggcagtgaatggttctgtcctgctggcattccaggtgccattggggtatgaaaaaaagctcctgcagctagctaggtgtcttcccaaattgccacccagttttgtggttgaaacccagggccctggtggcggaggcaccagagggaatctcttggtctgcgggttgcaaagactgcgatgtatctgggctggagtacaccgttcacagtctttcacagcttcccttggctagggcagggaatccctgaccccttgcgctccccaggtgaggcaatgccccactttgcttcagcttgccctccgtgggctgcacccactgtccaacgagtcccaatgaaatgaattgggtacctcaattggaaatgtagaaatcacccatcttctgcattgatctcgctgggatctgcagaccggagctgttcctatttggccatcttgcccagaatctcaa

SEQ ID NO: 826 - DNA, 2221 bp, Homo sapiens
acagaagtggttgggcgtcgtgaggaacgcatcggcggcagaacactcaagcggctggttgttgagagcacgccagctgaagagcacccctgcacactggcaggccatccacaggtgtcagaaactcagctcagctggaagaaacttgatgtaccaggtatcagagtagcaagtaaagccacaagccaaaaatgaaagagaatcttttaagtgcttatcgtgatggtgtaagtaattgtccaaaagaaacgccgattccttctgttccatttttacctgtggattgtggattgaaataaccattggaccatgaggagagactctgaagagaggctagtgatatgtgatataatactcttttgtgacgttggaccatggcagtgagccgcagctcccagtcagcaatgcgatcccaagaataaacaaccgattcttgacagtgtcctatgttgccagtcgattttgttcaacagtaggtacatatcacctgtagacccaaaacaacttcaaatagccatttccttcactgctgtgagcagatgtagacagcctgctgtgttaatttcctaaggctgctataacaagtaaccacaaacccggtgtctgtattagtccattctcacactactataaagaactacctgaaactgagtaagttataaagaaaagaggtttaattgactcacagttccacaggctgtataacaagacatggctagggagacctcaggaaacttacaatcatggcagaagggtgaagaggaaacaagcatgtcttcatatggcggcaggagaggaagagtgaagggagaagtgttacacacttttaagcaaccagatctcatgagaactccctcattatcatgagaactccctcactatcatgagaacagcaaggggaacatctgcccccatgatccaatccccttctaccaggtgtctcccccaacactgggaattatcaacgttgggaattatcacataaaatttgagtgaggacacagaaccaaatcatatcagtggcttaagacaatagaaatgtattatttcatagttcaggaggccagatattcaataggaaagtgatggcatgattgatttcttcaggaggctttcaggggaaatctttcttatcttctggtgttttctagcaatccctggcattccttgactttaagcagtgtaactccaatctctgcctccttgtaacatggtattctttgctttatgtgactgtgtattcatgtagccttcttacaaagataccagtctttgggtttaaggtccacattaatccagtatagtatgacatcatcttaactaagtgcatttgcggagaccctgtttccaaataagttaacttaggatctaggtggacaagactttctggaggacgcaattcagcccagtacatttgtttactgattatatatctatacacacacacacacacacacacacacacatatatataatatatattatatatacacacacagacactatatgtttatacatacaattatacatacaatatatagtataattatatatacatatagtgcattatatatgtataattgcaagtgtgtgtgtgtatatatatatatatataattttttaagggaataatgagttttgcatctgccataaaatcttttattcttcttgttagtgtaaacaaatgggagaagaaataagatttgacaaatatgccagggcaagattacagaaggacatatacattgtggtaaaaataataataataataataaaagtgattgctactttatggcaagaaggagcaataaaaatttgaaagtacttatgtagcatctactctgtggcaatactatacaagaatattctgaagagaggataaggagttaaaaagaaacatggcttgatatgtatcacagttcaaaaggaaaccattgtccattggtaaacgtagcacatttgggtttgttaagcttgaaattgaaaaaaaaaaaaaaaaaaaacaggtaaaaaaacaggtctagccaagctgaaatatacctagtgtaaataaaataataggatgaagtcccatgatatctcagtaagaaggcataaatacatgatcagggaagggattcagagctctgcaacattggcaaggtttttaccacaattatggtatttcttggcagaaataaaaaaattgggatataaaatgaaacaggcagttagagttata

SEQ ID NO: 827 - DNA, 4000 bp, Homo sapiens
gtcttcctcctgctctgtccaggaggaagaagtgcctccttcctctttgctttctgcctgaattgtaactttcctgaggcctctccagcctgcttcctttccagcctgagaaaatgatgaaacaaagcagagaggaagaaaatcctggatctgtcttggccaatggttggagaaaaaagggtagtgctacctaagaaaatttaaagcaacatctgtcaataaaatctgttaaaagagtcaaggacactgtatttttacaaattgaaggttgtggcaaccctgcatcaagcaagactattagcaccattttttttttcacatagcctatgctcatgtgtgtctctgtgtcacattttggtaattcttgcaatatctcaagcttttgcattattgctgtatctgttatggtgatatgttatcagtgatctttgatgttactatcgtaattgttttggggggccatgaaccatcctctataagatggggacttcataaataaatgttgtgatgctttgactgctccactgacaggcagtttccccatctctctccctttcctcatgactctctattccatgagtcacaacaacattgaaactaggtcagttaataaccctattatgacccctaagtattcaagttaaataaagagttgcatgtctctcacttcaaatcaaaagctagaaattagtgagcttagtgaggaaggcaagttgaaacctgagataggctgaaagctaggtcctttatgccaaacagttaacctagttgagaatacaaaggaaatgttcttggaggaaattaaaagtgctactccaatgactacacgaatgatacaaaagcaaaaactgccttattaccaatatggggaagtttgagtggtctgggtagaagatcaaaccagccccaacattcccttaagccatagcttaattcggaaaaaaagcattatttctcttcaagtctatgaaggctgagagaggcgaggaagttgcagaagaaaatttgaaagctaacagaggttggttcatgaggtttagataaagaagccataaccataacataaaagtaaaaagggaaaccacagtgctaatgtagaagctgcagcaagttatccagaagatctagctaagataattgatgaaagtggctacaataaataacaaattttcagtgtagacaaaacaatcttctattggaaaaaggtgccatctaggactctaccagctgtagaggagaagacgttgcctggcttcaaaggacaggctgactctcttcttaagggttaatggagctggtaaatttaagctgaagcaaataactcatttaccattccaaaaatcataggactcttaagaactatactaaatctactcttcctgtgctctataaataaaacaacaaagcctagatgacagcacatctgtttacagcatactttactgaatatttcaagctcactgttgagacttactgctcagaaagaaagaatcctttcaaaatattactgttcattgccagtgcacctgggcacccaagagctctgatggagatgtacaagaaaactaatgttttcatgcctgctaacacaacatccattctataactcatggatcaaggagtatttaggctttcaagtcttgttattcaagaaaaacattttgtaaggttataactgacatggatggtgattcctctgatggatctaggcaaagtaaattgaaaactttctggaaaatattcatcattcttgaagccattaagaacattcatgattcacgggaggaggtgaaaatatcaacatttataagagtttggaaggagttgattttaattctcaggtatgaatttgagggcttcaagactagtggaggtagtggctgcagatgtaatagaaatagcaaaagaaataaaattagaagtggagcccaaaaatgtaactgaattgttgtaacctaccgataaaacttgaacagataaggagttacaaacaagtgaaggattggagaataggtcaccctacaatatgcctctttggcataagaattattttgtcctgaaggcagttgagaagaaacagatacagaaaagctctctaccttcctcctatttgcctaaaggcaggacacaaatttacaaaggtgttcctcctctactctttaccaggaagggaaaacattgatcacagaagacaaatttagactctcatcagcccaaacagatggaagctgtataataagctttactaagtagactttatccactattagttccccagttgttgccttcctacaattggccactcctagaagctcaaggcccttttcctgtgtcttgtcattttctaagaattttttgttctttgttgaagatgctatgtaagctagagttctaagccacttctataagagttactcactccctgggtatctccgacatatacatgaaatacacatattaataaataggttaggatcagaatcctgaaagacacaattctgactgccataacctcaaatattgacattcctgaagatcaaaatccctaaagtctaacatccctagcatctaagatccccaaaatcacaatcacggaatagttttatcatgttaagtagaactactaacttgttattgcctttatttggaaattaagtatggctaaaaagatgtgtatgagtgccaatttgacaagaggtggacttaattttagatgtcagcttaagtggatttaggaatacttgaaacttggtaaggcataaacttgtctgtgtgtctgtaagagtgtttccaaagaagattcatgtgtgaatctgagtggactaggtggggaagacctgccctcaacattggtggacaacatccaatttgctagagtcccagagagaacaaataccaagtaaattcattctctctgagagctgggacagacttttattctgctgtcttggacatcagagctccaggcttgccaacctttcaattccaggacttacaccaggggtcccaggggcctgaggctttcagctttgaactgagagtaacaccattggttttcctggttttcaatgtgaaaacattaaaacttcctcaataaataaagaaatgttcttatcatacacctgcatttttgaaagataaaatttctccaggtctcagctctttgggtgactgcatatgcattgatgaccctttgaggtttttgatcaatcttgtcaaaagtcttcatctgtccatcacagcatttcagataatcgcaggcataaagctgagtgcacaaaattgccaaccatactgataggcatttatacattttgttttttcacttatttctttatgaacatggttcatttgctagacactcatgtgcctgtcatttgtatacccaagtttacgtttgaaacaatatgtgttatattgccgtttctgtcgtgtaaattatgtatgacatgttctgatgtgttttatatgtttcccaaataaactgcctttttaaaatgtaaataaatgtcttttaacaaatttttaaattattttttccagagttataatttcagaaatttgatcacgtgggatttcaacattcaggattatgacattcagaattgcacctcttgggattaaataagctcctttaataaacttctatttgtttttctatttctaatatgaaagaaacagtaaaattggtgacagtaagagatttcaaagttaaagtttttaaacaggttaaatatgatacaatttcagatacaaatgaaagtaacttttttgacacaaaatagtacatataattctagactaaaattttgataatcagtataaataatgatttatataaaattatgttattcaaatacaatcaaggagatataaaaatatgaatacaacacagaaggaattacaaaagttgccagagatagaaggagatttgtacaagaatattcattactgctgtgtgtgtagtgctaaattattggtcctctagaggagactggag

SEQ ID NO: 828 - DNA, 829 bp, Homo sapiens
ccagcttggagacaacatgtggttcttgacaactctgctcctttgggttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctc

SEQ ID NO: 829 - DNA, 2056 bp, Homo sapiens
atggcaatccaacagcagaatgggaggataaaataatcagaactagagatagctgaagcagccatcttgtgaccacaagcaacggactagtaggggaagagtcgacacactgaagagaagaaagcaagtgtttttttctagaaagaagaaagagaaaagtggattctcaactagaagcaaaaacatccactgaagtttgtgagagtgcaataggcaggtgccacagatctttctgaggaagtactaccatatgacttcaccttctcaggctgaggtatcagcttgactgtcactccacagatcaagactagaggtaaatgtaaacactatacaggtgggatgagaaacagctgttcagctgcctggctagaagaacaggcccagttctttgctacaggatggacatggaaaagttcaggcatttgaagttactggcgtcagccacatgagattgatgacgggattggcttctacaagaggtccatgtggttctcatttctgaaaacagatgtttggaaaccaatgttttcaaagataatatgaaactacaccaatatgctgcactatggagaaaaactaaccttgacagaagaaaaaagattttcttgaggcagaagatgaaggactattggtcgggacattcacagaagtctgttctgtaagttgggttatatggaagcagagatgctaggtcaacccatgttgtgccctccctcttttggtaagcaaaacactgatgcttatgacatcttccttttctttggtggtggccttgaaaattgttattccttccagaaagggctggatgtcactcgcttatgaatttgaatccttctctttttgccaaatgatagaactgagcttgctccatgagcttcatgtgtgtaaacattagtggggatccaagtggctctgcaggtagaatagacactcaggtccctcctgcccaagtccaggggcttgcttccatgaatccaatcctttagttcatatcagttcatggtgtaccagaagcctcaacacatctgcaaatttttacagaacatgtttgtgcaaggaaataaattaggtcaccaggccttcaaaggctccttccacttaggggtggtggagcccatgaagctgagaatcacccttgccagctgttggaacttgaaataatcctccaaaaacctcttgctattttaggagggtcatcctggtgggtctgtgtatgctgtaaaagagtggctcactatttaaccacccatctctactgtgctgatttagggaccacgatcacttgagcttttcttggtgcctgggatctgtctttctgcacagggataatctaggcttatttgtggcttttttcccctgcatttcctttacttgctcactttccttcttttcctcactatgtttccatttgaaatcagttttcacatatgcatttcagtgcaactctaccttcaggaacttactggattacacaggaaattccttatagtgtgtgaccatctgcactgcaaacaattttcagggaattgactagctactaataccacttacaaaaaatctaataaggggtttaacattttcataaggaaaattaatatttatattttctgttttggttgggttacatttttactattttgagaaaaaaagtattgcatttttaaaaagtgaacaaaaaaagctctcatacaattgaatggtattgccaaaagaaattaagaagtcagaatttgatgattcaatatattataaatatatttttgaccatagtcctaaactatcatctgtcaagttgtattattttgagtacataagtatttttcatgttcttatttgttttctataatgcctcataacatatatagctctgtgagtctgttctttcagaagatcttatctcttgttagttttcaaggatttccaggttcacagcagctgactttttactacacattttatgactctaaaaccattagaagaacatcaatgcttccctaaattggttttttggagaaaatgtaatatgtttgatgaattcaaataaaaagatggaaac

SEQ ID NO: 830 - DNA, 1798 bp, Homo sapiens
acccccaatgtaattctgtataaactcatgaatattattttggatggtaaagcttcagtgagttttataatggttgattctcaactataaacatgaattatccagatcatttaaaatattaaacaaacttccttctagaatatgcttttaggcatcttctcttgaccatcaagtttgtgtatgttcaaggatacaaactttctaaaggcttaaatttttgcatttttaggaaatgatgcaaaatgaatcatatagtatactttgtaaccaaataacgtttttattatacatacttctgtcatattatttctattgctatttttttaggcaggaaatattaaaaagtgaataaactttttctgtcgtaatatattaatgatttcttcaacaaggaatatggcctatgagtaattacaaatcctcattactatgaatttgctatatttatatattgcttcacagtttagaaattacttttatatcaattgccttatttgttacttagcagcaacctaaggttattttgaataaggtgtgcaggggtcattatctctagtttgtagaagaataaactgaggttcagaaaggttgtgactttctcagggaaacaatagctattaaatggtggagagggaactaaagttctagttgtctatatttttttaattcctttttttttttttgagaccagatcttgctcttttttttgagaccggagtgcagtggcacaatcagtgcaggcttgacctcctgggctcaagtgatcctcctgcctaagcctcatgagtagctgggatcacaggtgtgtgccactatgcccagatgattttcaaaaattatttgtagaaacagggtctacctatgttgcccaaactggtctcaaactcctgggttcaagtgatccttccaccaaagcctcccaaagtgctgggattacaggtgtgagccactgcactggcttaaagctctagtttttttttcttttttttgagatggagtctcactctgtcacccaggctggagtgcagtggcgcgatcttggctcaccatggcctccgcctccccaattcaagcgcttctcctgcctcagcctcccgagtagctgggattacaggcgtgtgccaccatgcctggctaatttttctgtgtttagtagagaaggagttttgccatgttggctggtctcaaacttctggcctcaagcgatcggcccgcctcggcctcccagagtgctgagatttacaggcgtgagccactgtgcctggccaggctctagttttttaaaagacattttatcatggaaaatttcaaacatgtatagattaaacagaatactgtacacctatgtacccatcactcagccacgacaattattgatatcccaccattcttatatcatctatacatccaccaactctcagccccacgtgatgataatgatggtgatttttaaaaatttttaagaagtttacctatactgaaagcactagtcttagctatacagtcttgacaaatggttatacctatgtaactcatacgcctatcatgatagttctgtctctccaaaaaaaattcctgtatgtccttttgctgtcaactccccatcctgcccagaccagggctgttttgacttttttttttttccactggagactacttttgcttgttcttgaacttcttatgaatcaaatctctctgtatgtgttcttttgtgtgtggcttcttttattcagattcaagtctgtaaacgtctggttttttttaatcaggaatataatactatttgttgagtctggag

SEQ ID NO: 831 - DNA, 1893 bp, Homo sapiens
ttttttatagagacatgtcttgctgtggttgcgcaggctggtcttgaactcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagaagtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagattgccttcattcactttcagcaaagccaagggcgttgtctttcccttttcatatctgggacctcattttatttcaattttatttgtctcaaatcaagatagtaggaataatgaattactgttcattctgattttttggtacttgcaaaagtatgtgtatgtttttaaacactcccccaacttccagacttttataagattgggaaaatagcacagataatgtaatactgattggccttagagccagtgaccctggacaactcacctaacctttctgagtttcccatatttccctttttatcttccccttcacttacatgggtgaattacaaaaaaagttttactaccctaacatcaggaaggtcattataatgtagtagcaaagagcatagactctaaagccaaactgtctctttgtgaatcttggctctgccacttacctgtgtgtcctggggaaagttaactttatgggcccctgtttcctcaactgtgatattaggatactttcagtgttcacctctaagagttgtagggagtcaacgagtaaacacatgtaaggcaccttttagaaagctgcctcctacatagtaacctttctaaatctttgctgctgttaccattatgacattatcatgataccagtatcatcctcagtcaacaaacgatagataactcagagaatgaaaaggttgttcctttatatagtttccctagaatcaccttgtaccactgctgctgagttgcaatcattcgttagtcgtatgtgacctagattccattttctaagattattcaacaatgtagaggatcagcgtagtggaaatacgtctataaacatttctaagaattgaattcattgtaattaatagcatcagagaagctgaaaatccaaagagctaatctcttaacttcatgatggaggacaaagattttatcttttggaattttaataatgtttccagcatgagattagccttcaatattgatttctggaattctgttttcccttgtttttcattgattaacctaaaacttttgagatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaagaaa

SEQ ID NO: 832 - DNA, 5883 bp, Homo sapiens
gcagaagacgcggccgccacggctcaggcacacgcgggcgcccgggggctgcgcggccgcgccgcagaaggtgaaggaacagcgcgaggcacgcagccgccgcaccgtggcgcgcacgagctcagccggccggcgaccccagcgcgcccacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctagatgaagtctcacttgcccaggttggagtgcagcgcgatctcagctcactgcaacgtccgcctcccaagttcaagtgattctcctgcctcagcctcccgagtagctgggattacaagcacatgccaccacacctggctaatttgtgtatttttagtagagatggggtttcaccatgttggccaggctggtctcaaactcctaacctcaggtgatcgtcccacctcagcctcccaacgtgctgggattacaggcgtgagccaccgcgcccggtcagactagggatttagaagcaagactttgtcatttataagaacactgcagaaaggaacaagaatgacccagctagccactgaagaccacctctgaaacccatcaacatgaccggctttctataggaaaagtctccacagactcaaaaagtctctagtttcttgcccttaggaaggcatgccctgggaataatagtttggggacaagagagagtagagtgtttactgtcctatcccccattaaatacatggcagaacttccccagggaaagcctatcatactgacattaactcagtacctgtttgaacttggagagcattcagaattctcatcagtcaaatggccagagctgagaaggatagcttgttttgtttgtttttgagacagggtcttgctatgtcacccaggctggagggcagtggtgcaatcccgactcactgcagcctcgacctcgtgggctcaagcaatcctccctcctcagtttcccaaagtgttgggattacaggcatgagccaccacacctggctaatttttgtattttttgtagagacaaggttttaccctgttgcccaggctggtttccaactcctgagctcaagccatctgcccaccttagcctcccaaagttgtgggattacaggcacatgccaccacacctggctaatttttatatttttttgtagagacaggattttgccatgttgcccaggcttgtctcgaactcctggattcaagcaatctacccgcctcggcctcccaaagtaccgggattacaagcgtgagccaccgtgcccagcctgggatactttctaagaaccaaggaactatgtagaaaatcttcgccgggcacagtggctcacgcctataatcccagcactttgggaggccaagatgggcagatcacgaggtcaggagatcgagaccatcctggctaacacagtgaaaccccgtctctattaaaaaatacaaaaaagttagccaggcgtggtggcgggcgcctgtaatcccagctactgaggaggctgaggcaggagaatggcgtgaacccaggaggcggagcttgtagtgagccaagattgcgccactgcactccagcctgggcgacagagcaagactccatctcaaaaaaaaaaaaagaaagaaaagaaaatcttgatctctattcagtaactttaatacgtatattaacatgttcttgtttttggaacaatcgtcaaatcaagcaaaaagtaattttattttgttaatcaaaataaagagaaaagtagacaatatttagagcatcaaaagaatttaaattagaacatctttaactattggaaatatgcatttgaactcatgtctttaagaggaaaataattatctttcctagctctttcactgagatggcctcagagtagccttaccccaagatgcacctgagtgctcagattcttgaatgggtgctcttctcctcattacaaggaactagaaatccttggagaaatcactgattctggtgttcaagagataccagataagctggaacatcttatgctaggaagcaggagaagcttcaaagaaaaataggtccaggcagaaggatgcaggagacaagctagaagtgccaaatcaggacgatttgagtatcaaattgaaatacacccaattatgaaggtacccaattttcaagagccggctgggcgcggtggctcacacctgtaatcctaccactctgggagactgaggcgggcagatcacctgaaatcaagagttcaagaccagcctgggcaacatggcgaaaccccatctctactaaaaatacaaaacttagccaggcgcagtggcatacacctgcagtcccacctactcaggaggctgagccaggagaatcacttgaacccaggagacagaggttgcagtgagccgagattgcaccactgcactcaagcctgggtgacagaaaaagactccatctcaaaaaaaaaaaaaaaaatgaagagccatgaaatccatggttatcctcaataaaatttaaatattcgaaaagaatgtaggataaaatgtgttactgctgagtctcgttatttggttatgtttgtattgattcatttgttgtattgataaagattagtaggtggcaaattcttcctttagaaggttgtttgtgacccaagagggcatcaatacaaagaccctaaagctgggattccgaagcacagagtcgcgggagagaaccaaagctcatcgcatctggtttaagactccttcagagttggatcagcctaaaaacaggacatggtacaagattttattcattccaaagattgtaaaaattaaattcatcctgagaatttatcagtctatgtgggagctacagacttctatgagcaagcagagtacctggcattcctgaccatgctatttctaccaatcaacaaaaactactagatactcagaggggatttaatacagagagctggctacaacatgacaaaacaccagacaagggagggcactgtggctcatgcctgtaatcccggcacttcgggaggccaaggcgggtggatcacctgaggtcaggagtttgagatcagctagccaacatggtgaaaccccgtctctactaaaaatacaaaaaattagccgggcatggtggcaggcacctgtaatcccagctacttgggaggctgaggcaggagaatcgcttgaacctgggaggcggaggttgcagtgagccaagatcatgcccttgcactccagcctgggcaacaagagtgaaactccgtctgaaataaataaataaataaacaaacggacacacaccacagaagggacagtgaggcaacccagggaatagaaagagcagaagccgcgaccctctgtagggctgagggcacacaacacaggtcaagttaccgtcgcccgggatccagggtcccctggtggaagctggaacccacagatcagtgctgtgggagatggagccacagagaaacaactgctgctggagacatcagcaggggaagaaggcggaaaaatactgtagccgctccacacctccagcccaacgccccatggcggaacttcactagaggccccacggcagaagagcctccaggaacctccttgtggaccagaggagagagatagagaggcggcaggaggcaagggtgtgtctaagacaaacaggccacagccagcccctggccttcctgaaactcctcccttgggttcttttaaaattcaatattctgcttctgttccagggttaatgggctgaactgtgtccccccaaattctaatgttgaagttctaacccccagtacctcagaatgggactgcatcaggagacaggtactttaaaatagtcattaaggtaaaatgaggtcaccacctaatctgttatgactggtatccttataaggataaaatagtcattaaggtgaaatgaggtcatcacctaatctgttatgactggtatccttataaggagaggagactagacacagacatgcacagggggacaatcctgtaaggacaaagggagaagacagccatctccaagccaaggagagaggcctcaggagaaaccaaccccgcccacaccttcatcttggacttctagcttccagaactggggaaatgaatttctgttgttgaagccccagtctgcaatacttagttatagcagcccttgcgaaccagcacatccaagttctccgtctctgtctctaacccctctctcaactgtcggccataagtgagcctctgcccccaacttctggcctcctctatgttctcttccttggtgacctctggcagtgacgctcagtcctcatggccagctctggcctctcccaggctctggcgccgcaatcatctcttccacttgtctctgcttggatagtctgtcagcatctcaaaggcaacatgaataaaaccaaatgcattttttcctcccacaaattatctctttatcctgatttctcttatctctgttcatgacttgttcaccttttcactaggacccagaattcatgcatcttggagtcccaacttctccagcccctgtgtcttgtttatttccatagcagttggtaggcgggacctctgcacagtctcacatggtcccttctttctagtccaggcccagctcagccctcaccagaacaggcactagcacgacagcctgctggatgattcccggtgcccgtcccctgtttcccacggttctgcctcatccagcacactctgcacttgactgcctaaagcacagcgctcatcccatcactcctgcttctcaaactcctgcagtgcctgcccccaccccagaaagtgcaggcagtcttgcctggcattcaagaccttccactgagcctaagcaacatagtgagaccccatctctacaaaaaatttaaaaattagccaggcatggtggcacgtgcctatagccccagctacttgggaggctgaggcgggagaactgctggagcccgggagttccaggatgtagtgatccatgttcataccactgcactccagcctgggcaacagaagagaccccatctctaaaaagaaaagaaaaagaccttccattggacccacctaaccgggtctccctcattggcagccattcacttattccacgttcattctgcacctcctgcacacgaggtgctatgccaattactggatacatttaatccctcaacaactctgcatggtgaccattattgtccccatcttgcaaaggaagaaactgaattttagaacagttgaattttagaacttgagctcccataattaggtggggaaactgatgtttgaatttgtgtccttttggccccaaagtccttctctggataaactaggcaaccaagagcaaagaatgctctatacccgacaaaaatagaaatgaaactcaagatccaagacgcaagagtggcagaaggttcaaggtgcaccactgccagccctgacagcctttgtatccaggtcagttgaacaggccgggattgtccccaacttggacacatctaaaaagctgcaggtgggatgtcatcaaaatcacctgggaaaacaacctgctctgaaaacagaggcatgatccaaaagacaaagaggtttgtgataccctttctgtacaatagctgactatcagtaagtcattactgttttaaggaagtcagtcacacacacacacacacgcatacacacacagaaa

SEQ ID NO: 833 - DNA, 1471 bp, Homo sapiens
cggccttttacacagcacagcacccagccctcggcagcccagagcaggaaccaacagggtaggtgcccaggggccccaaaggtcagagttcctcgcacagctgccagggagcacagggaccgcagcacagggtcttctgctcagcaccgggaccccgctcgctgcagctaaagaaacagatacgtccaagggctccacggccggggccgggcacctggaacagggtggtcctggggcggccacatccactccttccagctaacacttcacagagatgtctgactgatgtccactgctcagctgcacccctgagctggtgagcattcaggtagagcacccacctctacttttctcaccccgaaaatcagagactggttctcagctggtgcagccaccgccccagcgtaccggatgcaggactttccctgcgaacactggacagtcccagcaaagcagacggtgggtcgctctgtatctctgaagaacagctgggcctgcgtgtgtcattctcaggcatctggcccagggcttctcctccaggaaggtggctgctcagctccgggcactgccaggggccacggaccccgcctcctttccaggctgttccacagcatctgccttcatactcacagccaccgcggcgtgcgtcccagggattctcagaatagaattctgtgcctctctcgcctctggaagtgaccgcgctctgtaggaaaatatcacagcacgccggcctcgaaaggccacgacgtggctctaaactgctctaagtatgtcagttacttagaacaatcagaaaggggcagaacaagctggggtgtggagtcaggggtcagggcacagacagcacctcttgtcttgcagagagaatgctagcaatttgcaagttacttgaaaaggtttgtgattttccaacgccctgagtaattctagccaaaatgcgtgactcgcctcacactagatgcttgctgtaattgtgtctctgtattaaactgaccgttctttggagcttcagaatggaccaggaggaaaaggtaaataccaacctcgctacaacctcagaggcatcaacgccctcctgctacagacgcatctgttctcgcctggctcctgccggctgccctgggagaggccacaaaatgccctccacggagacaaggcctgagaaccttcgggacgcccgctgccgctcactgtgttgaagaactgcccgttccgcaccccgggccctagacacacggctctgtggaggacgaggaagtgccgtcaggtgagacttcaccgtgaaatatcttctgagacacaacaatctccctgaattaaaactacagactctaatttataaaaactgtgtgtttcaaaagctccaagtgtttacattctccgattcatcattccttcttctaatttattttaggaaataatgcaaagtactcacaaaaatttatatagaaagatgttcattgcagaa

SEQ ID NO: 834 - DNA, 4401 bp, Homo sapiens
ccccgcggcaaagttgcccacggagaggctctgctgcacgatctcgcgcacctccttgtcggacagcaggtagggagagcgcactgggaagctcggtgaaggaccaccacctcatccaaggggatcttgcagaagtccttgctgctcctctcaggggcagcgggggaccctcaaactcctccctgaacctctcaggattgattgcatagctcctcatgtttctacactcggggccagcacgtggaccttgcactgctgctggtaggagcgcctctgttcgtgttccagtgcaggttgcccatgaactccagggtccagacgcgattgtttttggtgcagaggtagagcaggtgcacttagtggcgaatgagcttgatgcaggacgggtccagctgcttcttgcccagggagtcgctgcagctgtactgcttgtgcaggttgtcatgggtgaagagcttggggaacaggggcaccagcaggcgcgaggtgaagttgccgatggacaggctgctctcctagatactgcgaagatgctcgttgctgagcaggcagtcggcgccgggcaactccaagttgggctggggatctccaatttgtccaagtcgataggtaccagtcagatcttcttggagcggcaccgctcgcccttgaagctgtcctccaccctgattactgagatgtcatcgggcaggctggaggagttgtagcagttgttgcgtggggggcttgccttcgctgcccgcgtccagccccaggccctggagcttgtcgttgatgcactgggcgcaccgctgcagccaggcctcctcctcctgcatgtgggggaagtagacctccgtgtagttgctgatgatctgcagcctctgcgggtccagctcctgcttgccgccgtccccgtagcagctgtcctgctcacccagcttgctgtagtggaagagctcagggaagagccagtggaggaggaagacggcaaactcaccgggtgaagaggcttcatccaggaactaggtgagggcctacatgtccaccacgtggtctgaggcgatggtgctgctcctgtccagagacaggccctcctcctcatctttgtggtccaggaagtggccggggtccactgctcagcctcaagctggcagcctggccaccaggctggctgttctccatctcccgctgggcccagaagcggctgaagaacttactcagctggggcaagcactcggcctgtcacacagccctctccttcaccgaggggtagtagacctccatgtagttgtggatgagctgcaggtgcagtgactccagcttaagcttggcctcaaagctgcaggcactgcagccttgggagaagttgactgtggctgaagagcttggggaagagctgcaccagcagccagcaggccaggaccccacctgacaggctctggtccaagatctgcttgagctccatgcccgtgagctgctatggggtggtgggggtcggctggaatttggccaccatctcagtggggttcaccttcagggagagcaggtccactttgctgtgcagctgggacctgttggacgtgagcgtgttgagcatgtagaacatctcctggatcaggaagtagatgttagggtcactgttggtggctgccccagtgctgccacagtcccatttctatggctcattcaggagcctaagcagcaaggggctgttgctggcatttgccttctggaagagctcatatgtgtttagcaggtcccctgagggagggttcttcttctccatgaccttgtgcaagatgccatacagaggcttcttgtagtaaggggtggtggcatggttgcggggctcctccttgcctgcccacacagagcctgagctcctgccttgccagcctgctctccattgccttggcagggcgagctgttcttgggttccacatgcctgctaggagcgcctctgggatcagctacctcctctccacactggggatggagtctggctggccattgctgaccagctgagtccttgagggcagtaaagacgctgtccagagggtgcttctcagaagtcctggaattcacggagcagcctagagcagcatctttggcctctgtctccactctcacttcttagaagttcttctacatcaattttttttggagatggttctgactctgtcacccaggctggagtgcagcagttgatcagagctcactgcatccttgacctcccagactcaaaagagcctagctacttaggagtagctaggactacaggccacggccaccatgcctggctaatcttttaaattttttgtagaggcagaggtctctcactgtgttgcccagacaagtctcaaattctcgggctcaagtggtcctcccaaagtgctgggattaatggcgtgagacaccgtacctggccatattttttttttttttcaaaaaattcatttgtagagtttaaaaagtatctttcgatcaagagttcttattgtatttatgtttgcaaatttcatttcccattctgttgcttgccttttcactcagtgagttattttatgattacaaatccctattttttatgttattttattactatttattaacctatttatcttatttactagccttcaatagttactttttgagtctttttttaaatcttaaggtcatagaagtgtcctctgtattactttttaaaaactgtactgttttatgttacacattggcttctatatgaaataatttttgtgtatgttgtgaggttggatgttaatattcatttttctctgtaccgatgtatgaaagacaccacaatttattgaaaatgaatcttttcctcattgtactgaagcactatttttttcacaaatcagctaaatatattgtgtggttctctttatgagctctctattctgtttcattgaaatatctatacttgcaccttttccataatgtcataattgatatacatttataaaaactttatatctaatagtgtaagtcttcacattatattttttcttcaaagttatctatacactgcattttcatttgcattttatagtcagtttttcagttgccaccaaatataatgcagacaaattatgctattactaatcacagtattgtgattttcagtgtattacaaatatagatttatttaaaatactgaatctttcttctaataccaagaatgacataggaacatggtacacctttatttctgttgaatatctttaatttctctcagtaaaatctcacaattttcagtaaagggattgcatatgctatgttatattttatattaggaattcaatgtttcttcctggaaacatttcagatttttaatattttatttgatttagactcactatatttggaaagctttaattgtaattttatttttaatagatatagagctattcggatttgctatttattcttgtgtcactgttaatgattttctagaaatgtatctatttcatcaaattatgtcaaaatttttgacttaaagttacttattacattctctttttctatcccatgactatagaatctataatgatttccttgttattattgatgatatttagaatttgtggatactctttttttttttaatttcacgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgagattgacaattagattattaattttcaagctttaattttttaaacaagcatatgcatttatctccaagctgaggtttgcctaagcctcccatcttttaacaagcagtatttttactttcatttttattaaattcaaaatatattttaatattcattgtaattacttttttgatgcatgaataacttagaaatgtgatgcttaatttctaaacatttggttactttcaaagtcttgctatagatttgcagcttaataacattgttgtacaaaaaaacactgtcaaggatttcaaatttttggtatttattgattcttgttatgggcctaacctcagcctatatctgtctatctaacctatctatctatctatctacctacctatctatctatctatctatcatctatctacctagatagacagagatatctatagatagctatggtaaattttgaaacacgttccaaatacattataataaattgtgtgttttgctatttttgggtgcagtttttatatcaaagtatttaatcctactgctttaaatttttgtattattattgatattttgtatcctttttgctatcagttattgaaaaaggtatattaaagtctttatgatcaaag

SEQ ID NO: 835 - DNA, 1795 bp, Homo sapiens
tgcatgaacaaaatgaaaacttcaccaaagagaaataatagaaaagaactaaacagaaattctggagctcagcaatacaatgaatgaaatgaaaaatgtgatagagagcctcaacagcagacttaagcagaagaactaatctgcaaactcaaaattaagaaggtgctgtcactcccagttgccaagtcaagccccgtcgaaggaaaagcatgcatagaaccaagcacagccaaaatttctttcccaggatcagcacctccttctgaggctgcagacaaagactgtcaagggaccccattactccctgttgaagtctcagagctcatgggtgtagcttctttggtgtcaggggctctggatgctaagccagtagagaatcctgaagatcctagccaacggattaataaaaactggaagaaggcaattgtgacatggcaggaacaaactgagagaatatttatattttgaagtagatggatccaaacaaagaaatgtgaataagatcaaggagtttggctaggggtctgagagacactgtcagaccaacctgcatttgaaatgggccagtgtctgagtcatgacaacataaaggtaaaggtgccctgaatgtgcccctagtccctgggtctgctctcgtcacctcttgtcacttcaggaagcaacagccaggagtgaaacatgtaacctgaggtgggaggaaggaatttttcagaagctcttcctggacaaggtgagtcctcatgaactgatcctgacccctatgaacccataccctatgagctcaacctcctagatgaggagcgttccacgaataagacccatatgttaagatcctggagcctgagggatcaggtggcctgatggggcagacagttctaagttgcctcctgttttggccaatcttctgggaagcataggtacctggaagggtttattgagatctgaagaagaaggcatcaatgtccaggagagccttactttcatcatgggtagcccaaacagtcagccctcaaaataacttctaaaacaaccagactattcagataagatgactgattgctcttgccacctaacctctgaggtcctggttgaatagtccgtcgtttcctaccaggaggccctgggaggtccaaagacattttccccctggcactggcgacctatacctggtttctatggaggctctggagaccctgatgggcagttgatccacatcttctgggtcccccaatccctccagtgaaagatgaccccttctgggatagcccaggtgaccccatgcagggtggcctaatattgaggggagagtcaagaaccaattcctggatcataccataaagcctgtggtggccaaaaagaaaatgaacctttcccacctcctccactctgaggggccagaggaagtctctctggagtaggacccctaaatggatgaagaaattctggtgggatcattgttagagttggtgggcatcatcaccaataagcatctctttcatgaaagtactggtggtggcataagtgggggcagtgaagatttttcatgaaggtcctggacatgggggatgctgtgaccccaagcctcatgatgtccctggtcactgaggccatgaccatcaaggtctgccctctcgtgagcactctggccatgatggccctgggccactgaggtcaagatggaagctacagccatgaaggagacagatcaacctgctctgtttgctgacatttgatgataaagggcaatgccactatgagaacaattacgtcttttaccacctgagtgtcaaagtcc

SEQ ID NO: 836 - DNA, 4335 bp, Homo sapiens
attctgatgtcaccgcttcctaatgagaagctagaaaatgcaattctagagtgatacacctttaagtcttgaagaatgaagatgaaatattccaaactatgctgcacaagaggatgtgaacagaaacatctggacggagaagatcttttttatattcagccatgccaattgacctactaccctctccatagccaaaggaatgcccaaatttccacagaaaggcatttttatgtcttacctcaaatggtcccatggaattaggctctcaggccctggccatcacggcactatctgtgtaaggaacttctgcaaagccttcctggctccttgatggattggctttttggcttatgcctgtaatcctaccactttgggaagctgaggcaggaggattgcttgagcccaggagtgcaagaccaacctgagcaacattgtagaacgtcatctctgcaaaaacaaacaaacaaacaaaaattagctgggacaggacagtccagagagaaccaacagcctttgcctgagctctgctccagagctcctccagccccgtgatcaggcactaactataacaactgaaccgatggaagtaaatcctaccccagcggggcactggcaggattaaagcaggtagtggatagcgtcttgcacagtaccatatacagagtaggatctcctacacgtggtaggattcttgacttgaatagaaacagaacccacatagcacagcaataagaaaaataagattctgcagacaccaatgctagtctcagggctgccactaactaggtatgtgactttgaccatgccccttcacctcctgtccgtgattttctcgcgtgtaaaatgaggcactattgtttagatttctcaagggcttccagctgtaacattctacagtcctgtgcattgctggaattgcaggggaacaggggagggagggtaaacctcacatgttcatgttttaaaatttcaaatgaagaaagttgttgttttctcctcttcccttctccccagtggtagcaaacaagcaataaatatggaaatcctaaaagccagagaaaatagtgagtgttctccattttgctgacaaagtacacagaggctgcgtcacaaaatgaatgtgcttatccctcttgtgtgctgcatgaattcctcccggcccgagcatggctggaccactcacaggacagctgtcctttgttctgtcagtacagggtcccctgcttgtgtgctgaccagcgcagcactgggtgactactgcagagtgaaggtgtgtgttccttctccagggagccccgaacagatggaatccatgcttagtgcagtgactggaaggaggtagaaacaatgcaggtgaattgggagggcagtgccgggagacagcggaagaaaagagaaaaacaaaggcaaggtagagcattccagctgcaggcagccaaagcctctcctgccaagggacaggtagctggttttcaaaattgtgcagacatactcagtaattgctctgcaccatcttgtctgccttttaagcacaagcgaggattgcatctgactcccattaccagcaaatgtcccaggaaggaccttaagtaataagagccttttgaagctgatcttcagaagcctcttcccaagatggcacctgggaggaggtgtggttgtttagcggctctgtcagccccggacgcacaagttgcttataccctgcgcagctgtctattatgaagaagctcatccctgtggacctttctcttgaatgcctactatgagtcactcagcaagagaggcacccagctccctcaaggtctgcagtgcctcggaggcccacttccctccatgacacagtctctgaacatattattcctcacggatgatcaccttcttaactccatccagacgtgtgcctctgtctcactatttagcgttgtcctagaaaatactgagtaattgtttcatgcgtatacatcatgtttcctcaagtagaatctacctttatacaatcaaaagtgtcagattgatggatgagtagcagaacaagaaccctcctcctatggctgttggggtgcaagtacccatttgcctattggaactgccttagggaagatacggttaaacacagaccccaccccgcaagttattctattgaggaaaagtggaaataaggtgagtgctactacccaaccacccaacccacacctctgttacaatactggctttttgacaaggaagcattcattctttctggcaaaacattgtccactcttagcagttcttccacggatatcagacctatatgccagtggcaacacagtaagtcagtagcattctataagcactcgttcaaccatgttttcggcgtggtttctatgtgtcagtcattatcccaagcggtggccaaggagaagctacagaagcagattcgaccaggccctttctttgaatagtctgtggtcccatgagggaggcaggtgagaatcaaggctctgtgataactgttccaagggagatacacacagagcatgtggcatgctaagctcctcttggggtaattgcaatgtttgccttctttcctttgaggacttaagtgtgaagcctgtgcacctggaatgggaggggacagggattctcataagaacctttatgccatttgtatagcagttaacagactgacaagaatttcaaaatagcatcagacgaggcgatgagcataggggtccttagaaatatttgcttgttttatggtcagaggcctgcaggaagcagctaataactgatctcttcccatagcccctaatgtcctctccgtttcaatcatggaccagagtatagtgtgacatttcccatattattgatttgagttgttatttatttcttttattgccatataactgtttacacccttggctagaatttaagatgccggaagacaagatagtgccttgttcccctgcctccactagcacagcacctgactcacagtaggcaatcaatgcaccgattaattaagtcctccttctgctgagggcccatcgtcctttggctgtcccagagagctaacacctgtccccgggaccaccctagacacaatggcacgcagacgaacgagcctccttcgtctaccttccctccgcgagcagcatcaaggacctgagaggcaaactcaaggtgaattttaaaacaccttcagtggtggttgcagagcaaacctgcctgcaagaaaaggattttttccatctttcttcagcgccactggagcggctccttccattgaaaatacagggatttgtgctgcatgattgtgcagggagtgggggccgagtccacgccagtcatcaagggctcagcatgctcagaagggctttgtgctccaggcactccagcagcctggcttggccttagcacatcccccttcctgaagaggccacagtacaaccacttcagcaagtgacttttcagtaatggctctgtgtgcccaaaagggaaatcaatgtgacggttagaaaagtttctttttttcttccagtcctgtgctgtccccaaaatatcagaataaggtttgttatctgggcaaaggaacaagcgcaagattttcttttatgttgggtgaggagctaaaggactaaacatttttgaaaacctatgatgtaccagagactgtctcacatcctgccctatttaatgttaccaggagatcgttggtaaggtgttacccccatcttaaagaggaggggaccaagattcagggatgcttcacaagctaataactaaaacttaattctaaagtgtgtggggtgcgtgtgtgtgtgtgcatgtgtgtgcatgcatgtgtgcatgtgtgtctggtctgatgtcttagtgttcatatccatgagcatcaggagagcttccacttcacccatgtttcaaactctagagaggctgctccccctgctgagtagcctggtcgtggccgtggctgggtgatggctgtttggatgctctcagaaatgtcgtaagcagttcacttattattcagggaaacatccaacaaagtgatggcttctttccttgctatcactatctactgccagctgttcacttgaattgaaggatatgagggactgaatgctgaattcacgaatgcagctaaccgcccccctccagaccccagaggagccattaggatgagtgtttatggagcagcactgcctggaaatgccaaggcccagtaaggaatgagaggtgaacggagaaatacacgcgtccctggatccctccctgggtggggaagactgtgtcgtgggacagggggcttcaaatctatgggaaaacacagcaaatacacttctagttctt

SEQ ID NO: 837 - DNA, 1767 bp, Homo sapiens
gcgagaggcattgaggcacttgagaaacaggtgaggcagagcaggagggaggacagggcagacgccggcggccaggcaggatatatcaccgttccactgccagggtcataaggggtggggttccaaaagggtggcttgtccagagaggccagcattccagtgacagggactgttgccatctcccattcccggcttcctcttccagaccttattgtggtgtggcttcatttctcagagaagagccatgaaaagatacaagcatcttctctgacgtgggtccgctggtctcctgcgggacaaagagctcctgtggggctcgtgtcctcgtctgcagtgtgttcatcttgatcctagaaaagaggctgttcaggatggggaggatatttcaattgctccgggactgaagaatctcctcacgtgggccaggccttcacacacccaaagcggaaccgcgtcggcgaaaaggattgacaaccggtctcatgacccaggcagagaggcagaaacaggctcaccaaagacaggccgccatgcgagaaacagctttgtggtgcacagggcacattcggccaaggacacacacgcacacgggcacacacacacaaaccgacagagagagggaaagaaacacacagagactgagagacagagagagaagagagaatgggagacacacacacatacacacacagacacacacacagagtcttatagcaaaggcattgaaagacacacacccaggcaacccctgaggctgtggggttctgctttcgacgagaacgacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgtttggccctttgtgactcttggcatccggagactttcccctcgacccagtggagtcgtcaggccggagcctcagagccttgacacccaagcactgccacggaagtctccccctttgccaagcctcggggactggtttctaagacaaccgtgggaaccactgtgacgggagaaaccgcttgtgcttcgcgcatgcgcattggctgggccgactcctcccctcctggcagtcaggctgcgtccccttcaaagaacgccaccgctgagaactgaccctcacatctcccttcctgaatttctttagggaaagcaacaaccatccctgtaagccatgggttttcatgcggaggaaggagagggctagttgtctgagagggaaactgcttaaggctgcagactaggaaatgggattccaggtttaagatagctcctttctggacctcagtccttcacctagtcacctagtcacagggtggatcgcctctaaggatacttagtggaaaaggaaccaaattcgggatggttctccttgctttaagccttgatgggagacggggaggccaacccttctctgcagaccgtgatcctcactagacagaggagctccaaacctgcccatctcatcccatgcacctacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaa

SEQ ID NO: 838 - DNA, 1676 bp, Homo sapiens
atcccggcccctcctccgccagccgcgtcctcccgggcttggtgaggaactgttcctggaggagccgcgggacgccaaaaccagccaatgggaagcggcgattcgcggagattggcactgatgatgggaagcaatgataaggaaactaaactggattaagtgctatcatcttggaggtgcaaaggcaaacaaggagaaagaagtgattgaagagcacttcagaaagcttggtacattcaaatcagcagggcttgattactcgcatcccaggacacttaaggaattggcaaatataattgcaagaccaccagcctttattttagaaaatgaaggttggacagaagaaggtcctgacaagtaaaatcagcagatggagtacctgttttttaaaagagggaaaaggacagctgtagtaattatagactattcagtttatcttggatacctgggaagatacaagagcaaatcatcaaacaatcaatttgcaaccacctagaagagtacaagctactgggtcgtaatcaacgtgattttgtgaagtgcaaattatgccacaccaatttaattttatctatgatagagtgatgagcctggcagaagaggggaaagcaatatctacaactggacttcaataaggaatattgatctcagcgttactttgaccattaatgaattatgatggcaataagcaaagattcgcacctctagcctccggggagcttaatcttctgctacaacatttgcatttggtgtctctctactgctcaggctggagtgcagtggtgcgatcatagctcactgcagcctcgacttcctgggctcaggtgaccctctcgcctgaaaccatattccccctcaagtagctgagactacaggcagtgtttaaggaggatccaggaatactttaagtgacgccagcgttagtgttgcctcctcagaagactgctttcaggggaacagtatacatctgccctgtaaattctggatggtaaatatgacaaaaactctctccttgacccagctctagtgagactgctctaagccctcttctcaacatggctcaaccttgggcttcagtgtacattttgttgggcctgcattgctcagttttagcaagagtccagttaagtgaaagagaatctcacagctttgatatcagattcttccatatctaaacaaattcctcatcccctaccttcaatatctgatcactctgccctgtttgcaccaagaatctaccctcacccttgatgtctcctcttaataattttccatccaccaatctctccccactcttcaaacctgctccttggctataagtccctaccccttcttgtcttatttgcaatagagctcagttctacactggggtctctttttcctgattgcaatagttcctgaataaaatctgtttttaccactttatccactgtctagctctggttttctttaccagaagtcacagttaacacatgcgaaaacccatttgcaaaacaaatccacaggactcggtccatgtgctgtgaagtctttgattaagggcttaaaaacaatgaaaagtaataaacggatctgaatacaattcaggcaataaaacactttcattggttttcatactcagcaaaagtatttttactgattaaaagataaataatcctcactctactaactcaatg

SEQ ID NO: 839 - DNA, 2204 bp, Homo sapiens
ttaacagtatggttaactgttttcaattaaattatgtcatccacatccttcagttcttaatttttattcatctctaggtcctcatattttgaaagaccacctgtgctatatgtatgatctgcttgtccctgtcaaaactcaggttgaaattttgttcccgatgtggtggtgttgggaggtggagtctcgtgggaggtattttgctaaatttcttgaggtacagaataaatgaatgtcatcctcagcgtaccaacagtttgaaaaaatgagaagaaaaatggcagcagtaaaagaccccattatgaacacaggctagtaactttcttaatccaaaatttcaatttgttataatgacaagtacattttattcatgacaaatgtaaagtattgaaagagaaataatcaaatagtttatagcctatactcctctatttcctgaggatgctggctttgtaatttttgatagtcaagaaaacgatcataaacctaatacaatgcttttgtttgtgcaaatattctgtcacatttcacttggaatatggagtataattttgaccattgctttttgggtgacccatgataaagatataaattgtctagaaaggcaaatagattatataaatgggattctatataaaccaaacacaaacttctggaaagttgaagagtaaacgagatgattaaacatcacaaattaacatggtgcttgtactcaataaacgtagctattataattatttaaaaattaataaagagttaatactatactctttataaaatgaaacaccaggacaagaaaataatgcaaaggatagcttaactgtgaaaaataatttaatattaaataatgctgaaagttgttaatcccaaccaatacagtatatatctttttagtgtctcttcacataaatcttatataatactattgcacaagtttgttaaaagataaaaaactactaaaaataaatctgtgtgtgatttttagaagactacatatttatgtgttccacatattgaatcaattttcaaacttcaaatttttagagtgcttttggagtggaacacatcctgagtgtgccctttcagtccagtctcttactgatgctctcctaatggcattcacacatgcatacagctcgccgccctagaagcggcctgctttaagattgaaaatatgactgagagtggccaaaatacaactctctgtgagtgatccggttatgtcctaattaactttcaatgtgtcaaattcaagtgatagaaaatggccaaggaattaaggaggtaagctgagattttacacttttctcaattttaagcttgttattaagtggaaaataaagactacacgcttttattgctttaaaaaagacaaaaaatgacatttaatgacattcttgaagaagatgaacatttgtaattgcaaatggaactccttggaaaataagcgttcgttgcttttgttgcacagatctttcttctccagttcaacatgaatctcgaacttttaaaatccagatgggcagcacatgacaaatatgggtaaactcagccaatgaaacaaaagtatttgtttccaccctatttaatgtgttacttcctccaagtaacaatagaaaactaaaacttcttgaaaataaataaaataccaattaaataccaattattttaaaagtggtgataaattccaagaaaaatatgattatattcattgttattataccttcaatcatatttaaagggcattttggaactggataaattaaaatgtccaactaaaagtatcttagttaaccattctgtttccagaaagaacataaataaatatatctcacagcaaattcttaagctttatataactttattttcatcactttttatctctaggatttaacaaagagctgctgaaggtttcactgatgtggaagcagtgaatttatatttcagaaggaatacacagataagtgatggattcagagaatttataagcttaaaaatgaattttaaaaatataaataaaatgatatctgctttgtgatcaaatccatttgactccatgttattgttttaatgccctagtggagctacttctctgcacagctttctgggagtccagagactgctctatacattggaaaatatgatgaatgtgttcaagaggggcgtgacaattgttccgtacacagatttttccaagcattctc

SEQ ID NO: 840 - DNA, 10546 bp, Homo sapiens
agagccgctggtgcttcccaggccgtcgcgctcctggccgcgcacccagccagggacccagaggccctcagccccgggctctgcgcgtacactgagggcgcggcgcagcaggacagcaagataaggaagcagagactgaagggaggaatccccgctttccggggatgatggcgttcgagttgggtctgtgagggatgaaataggagttggccagagggagagagggactctaggcctcgagaagagcacgtgcagaggttccgtgacacgaaaacgccaggtgggtgcggggctgggaggacaggaggcagaagggtttacggctccacatggtcgccgaaattttaggtccctgagagtaaaggggtgcagctgatttcatctagaaagcccctggccgggaggagagaacgagcttgcttgcctggggttgcaaaggagtgggtagctgagacggccagcaccccagcatcctgactcagggccagacgcttcaccccattgggcggcgtctggaggagcagacacatctcttgtgggtaccctcgaaagtgaatcatgggtcgcagggaactgtggtcaaaccgtctctagctagatgctagagagccagctctgcaggctcaggctactgtgagacacgaaaggagggactcgctgggcacagcctcaccctggggcatgccagcaggccctgccctctgagtgttggcagacttgaacatccctagggaacgagagaagttgggcaacgatgggagagcagtgcaggccctggaggtgacgagtctgttgagattctgatggggatgggtcagaggacgtagaaagcagtgaaggcctagacgcccccaggtcagtgtagcctgctctgcttccagtgagctgggctcagtcccccacatgtcattgtcttagacgcccatggcctttgcacaggccgagcctgatgtttggaacatcgtcgcctctagggggcctggctcctaatcatgcatcacctcctccaggagaactttcctgcccctacactgagttcaagcttctcagacaccagccccagttgagttcgagttataaccgtcaccagttatcacaccatcctgtaatctgtgcggtgccccttagggcaggacctgggtcctagatgtctctgtacctctagccccaaaccaggcctgacctgtctcttgaaggagtatttgtgttgaagatgggtggtaacgttcagcaaaagccatgcccaggagacaggcacagtacccatggagacccagggccagctgatgacagtgatgaattccctttagaactggcggactcttgggtgcttggagacactatataaataaggaactctggctgtgtgcatgggagagtatattaacagggcttggcctggctgtgaggtgcagagatgccgtttctctcaggtaaggagccatattggggcaggggtttcctaatccttttttgactcacaaaatacacctaggaaatgttaaataaatagtcatttttgagtagtatatgataaagaagtgattgattttgactaaaaatattcatgttctatttttagaatatgaaagattgtattataaagatcacttgaaataaaattttagataatatatggagacaaatttctgctttttacatttaacttgctgtttaatgtatctcaaattatttatgtaagagatatatgatttgaccaataaatataaaaaaatgttataccataatctggggacctaaagtacttcactttttttgttctgttttgtttttgagacagggtctctctctgttgcccaggctggagtgcagtggcccaatcatggctcactgcagcctcatcctcctgggattaaatgattcttccacctcagtctcccgagtagctgagactacaggcacatgccactatcgctggttttgttgttgttttgttttgttttgttttttgagacagagtctctgttacccaggctggagtgcagtggcacaatctcggttcattgcaaccgcctcctcccgggttcaagcgattctcatgcatccgccttccgaataggtgggattacaggcatgcgtcaccacacccagctaatttttgtacttttagtagagacagggtttcaccatgttggccaggctgatctccagctcctgacctcaagtgatccacccgcctcaagcctcccaaagtgctgggactacaggtgtgagtcaccgtgcccagccgcccagctcattttaaatttttcttgtaaagacaaggtctcactatgttgcccaggctggtctctaattcctgggctcaagcaatcctcctgccttggcatcccaagtgctagcattacaggcatgagctactgcacctggccctaaagtacttaaaatgtaatttaaaatttgcacctgggaggccagacacggtggctcacacctgtaatcccagcactttgggaggccaaggcaggtggatcacaaggtcaggagttcaagaccagcctggccagcatagtgaaaccccatctctactaaaaatacccaaaaaaaagccaggcttggtggtgggcgtctgtaatcccaactactcaggaggctaaggcagagaattgcttgaatccgggaggcagaggttgcaatgagctgagatcgcaccactgcactccagcctggtgacagagcgagactccatctcaaaaaaaaaaaaaaaaaaaaaaaaaaaagtgcacctgggttaggcatctcccagaagccagagtgattgttcaaaaacttaaatcaggccaggcacggtgtctcacacctgtaatcccagcactttgggaggccacggtgggcagatcacctgaggtcgggactttgagaccagcctgaccaacatggagaaaccccgtctctactaaaaatacaaaaattatccaggcatggtggcgcacgcctgtaatcccagctacttgggaggctgaggcaggagaatcacttgaacccaggaagcagaggtttcagtgagccaagattgcgccactgcactccagcctgagcaacagaacaagactgtctcaaaaacaaaaacaaaaatcttaagtcatctcaagttcctcttgcttaaaacccttgaaaggctctccagcatagtcaaagcaaataccaaaccctttaccatggccttcaaggccctgcttgatctggcccctgcccacatcactgatcttacctcttcctactctttagccttattcactgcactgaaatcccactgccaagcttagccccaccttggaggctttgccctggctgcacccctctcctagtgctcttcctccacaacttttagaggctagctcctacataccaggcagatttcagaagacctttcctgtcatccaatctgaaaaagctcccatcccaatcagcgtctatcacatcacccttgttcttcctttcagagcacctaatactcccagaaagaatcacatttctgtgtttgctagttgtttattatgtctcttctaccaggctgggaacttcaggaaagccaggaccaagtcaatcttgatctaggctctgtcttcagcatctagaaccaggcttggcaccaactgagtaggtaatccgtaaataaattgctgttgctgtgtatcaaaaagaaaaaaccaaagtttgcatggtccagtgcttagaagttttgaaataaaaaatgtagctattttttggctgggtatagtggctcacgcctgtaatcccagcactttgggagtccgaggcggtggatcacctgaagtcaggagttcgagaccagcctggccgacatagtgaaaccacgtctctactaaaaatacaaaaattagccgggagtggtggcaggtgcctataatcctagctgcttgggaggctgagcggggagaatcacttgaacctgggaggcagaagtggcagtgagctgagatcgtgccattgcactccagcctgggcgaaagagcaagactcagtttaaaaaaaaaaaaagtagctattttttaaattggaaaaccaatcacatgcacatagcaaagaattgaaatagtacaaaagtgagcctgtttgcctcacaccttcatattgatcaggataggacaggctggtctgtggttacagtgatttctttttttttttttttcttccagagatggagtctcgctctgtctcccagtctggagtgcagtggcatgatcttggcaatctgggctcactgcaacctccgcctcccagattcaagcaattctcctgcctcagcctcccgagtagctgggactacaggcacacgctgccacacctggctaattttttgtattttagtagagacagggtttcaccacgttgcccaggctggtctcaaactcctgagctcaggcaatctgctcgcctcagcctcccaaagtgctaggattacaggcgtgagccaccgcacctggcagtacagtgatttctaatattgcccatgactgttggctgaactcaactggtgattcttactttgaatggcttatgtgactgcgatcacaccaggactggagttacctgaagactcagctgggcaggttactgttgatggctcactcatttggctggcaggagatgccatctattggctagagggtcggagctgcaaaccaaagcacctacatgtggccccttcacatggcttaggtttctcagaacatggtggctagattctgagagggaggcatcccaaaacatgcatccaacagtatgaaagctgccagtctcttacggtttgaccctgaaattagaacacatcacttcctctgcattctattaaccaaagcagtcacggaccagcccagattgaaggagaggggacataggccccagccttcaatgaaaggaatgtcaagccaggcacgatggctcacacctgtaatcccagcactttgggaggtcaaggcgggcggatcatctgaggtcaggagtttgagaccagcctgactaacgtggtgaaaccccgtctctactaaaaatacaaaaattagccggatgtggtggcgcacgcctgtaatcccagctattcaggaggctgaggcaggagaatcgcttgaacccaggaggtggagtttgcagtgagccgagattgtgccattgcattccagcctgggtgacagaatgagactgtctcaaaaaaaaattaaaaaaggaatgtcaaaaaagtctggccatctttaatccaccacatgtggatactaaataaaactccaaatctcagtcgcttaaaacaacaaaggcttatttcttactcatcccacattagacaatgatggtgtgctgttctcccccagcagggacttaaatccttctgacatcaccataatctcagttatttgattccaactgctcagattggggtaggggagagggaaaagattgacactaacacttaattgccttggactgaagtgatacattcttctgcccaattccgactggtgacatcacatctactaggaaggttgagaaatgtagtctttccatagtccctggaaaagagaaatgggtgtggatacatcactgtggctaacacacaccactttcccagtctcctcctctaaaagcatcaccactaacactacagagtgtatacttccagaaatatttatgcatatacgacacataaaacacaaaggggaacaggcacagtggctcacgcctgtaatccctgcactttgggatgctgaggcgagcagatcacttgagcccaggagtctgagactagcctgggcaacatggcgaaaccctgtctcttctaaaaatacaaaatttagccaggcatggtggcacatgcctgtagtcccagctactccagaggctggggtgggaggatcacttgagctcaggaggcagaggttgcattgagctgtgaccatgccactgcactcagcctgggtgacagagtgagaccttgtctaaaacaaaaaaaacccacagaaaaagagtagcatttacacacttctacactttgcttcttcctctttttttttttttttttttggacagagtctcactctgctctccaggctagagtgcgatggcacaatcatagctcattgtaacctcaaactcctgggctcaaacaatcctcccacctcagcctcctgagactaaagatatgagccaccacacctggccaagcaaaggatttaagtagacatttcttcaggccagacacggtggctcatgcctgtaatcccagcacactgggaggccaaggcgggcagatcacctgaggtcaggagctgaagaccagcctggccaacatagtgaaacaccatatctactaaaaatacaaaaattagctgggtgtggtggcacttgcctgtagtcccagctacttaggaggctgaggcaggagaatcgcttgaacccgggaggcagaggttgcagtgagcagcgatcacatcactgcactccagcctgggcgatggattgagacactgtctcaaaaataaataaatagacatttcttcaaagtaaatatacaaatggccaataagcatgtgaaaaattgctcaacatcatcagtagggaagtgcaaataaaaaaccacaatgagctagcactttatatctactgagatggctgtaatttttttaaaataaaataacagtgtcagggaggaagtggagaaaatagaaccctcatgcattgctggtgggaatggctggtggtgcagctgatgtggaaaatagtttggaagtttctcaaaaggttaaacgtacaaccatcatatgatccagcaattccattcctgggttcatatccacaagatcaaaagaatcaaaagcagggacttgaacagatatttgtatgctgctatagtttggatgtttgtaccctgcaaatctcatgttgaaataggatccccagtattaggcctaatgggaggtgcttgggtcatgggggcagaaaccttatgaagacataatgccctccctgggtgggcaggagtggtgagttcttactttatcagttcccagagaactgattgtttaaaaagggcctggaggcctggagcagtggctcactcctgtaatcccagcactttgggaggctgaggcgggtggatcacttgaggtcaggagttcgagaccagcctggccaacatggtgaaaccccatctctactaaaaatacaaaaaaataaattttaaaaaaatcagccaggtgtggtggcaagtgcatgtagtcccagctacttgggaggctgaggcatgagaatcgcttgaacccaggaggtggaggttgcagtgagccaagatcacgctactgtactccagcctgggtgacagagggagactctgtctcagaaaaaaacaaaaaaagggcctggccctcccatctcactctctcttgcttcccctcttgtcatgtgatctctgcacaccctggccccccttcaccttccacagtgagtggaagcagcctgaggcctcaccagaagcagatgctagtggcatgcttcttgtacaacctgcagaactgtgaatcaaataaacctcttttctttataaattacccagcctcaggaatcagagtaagacatacacccatgttcatagcagcattattcacaatatccaaaaggtggaaacaatgtaagtgtccatcaacagatgaattgataagcaaaatgagtgtgtacatagaacaaaatattattcagccataaaaaagcatgaaattctgatacatacaacatggatgaaacttgaaaacatgctaagtgaaataagttagacataaaaggacagatttataaatccacttgtataaaatatacagaatagccaggctcagtggctcatgcctgttattccaacactttgggaggccgagacaggtggatcacctgaggtcaggagttcaagaccagcctggccaacatggtgaaaatccatctctacttaaaatacaaaaattagccaggtgtgttggtaggcacctgtagtcccagctactagggaggctgaggcaggagaattgcttgaacccagtaggcggaagttgcagtaaaccaagatcacaccattacactccagcctgggcaatggagggatacttgttctccaaaaaatagtaataataaaaataaaacaaggctgggcgcagtggctcacgcctgtaatctcagcactttgggaggccgaggtgggcagatcatgaggtcaggagttcgagaccagcctggccaacatggtgaaaccctgtccctatgaaaaatacaaaaattagccaggcatggtgatgcacgcctataatcccagctactcaggaggctgagacaggagaatcgcttgaccctgggaggcagaggttgcagtgagccgagatggtgccattgcactccagcctgggcgacagagcgagactccatctcaaaaaaaaaaaaagaaattaaaattaaaaaaaataaaatatatagaatagacaaactaatggagacagaaagtagactagcggttaccagggcttagggggaaaagaggaacgaggaaatattgcttaatgtttacagaatttctgtttggggtgatgaaaaagttttagaaatagtagtggccaggcacagtggctcatgcctataatcctagcacttggggatgctgaggtgggtggatcacttgaacccacgagtttgagagcagcctgggcaacacaggaaaaccccatatctacaaaatatataaaaattagtgggggcgtggtggcatgcgcctgtcatcccagctacttgagaggctgaagcaggagaatcacttgagcccaggaggtcgagtctgcagtgagccatggctatactactgtactctagcctggatgacagagtgagactccgtctcttaaaaataaaaaattaaagtatggttaaaaaggcaatttttgtgttacttatgttttaccacaattttttttttaaacctcactcaaaaaagaatgacatcatcttaggaggccgggcgcagtggctcacacctgtaatcccagcactttaggaggccaaggcgggtggattgcctgagtttaggagttcaagaccagcctgaccaacatggtgaaagcccgtctctactaaaaatacaaaaattagctgggcatggtggcacacgcctgtagtcccagctacttgggaggctgagacaggagaatcacttgaactcaggaggcggaagttgcagtgagtcgagatcgcaccactgcactctggcctgggcaacagtggaagactccatctcaaaacaaaaacaaaaaacaaacaaacaaaagcaaagtaggccgggcgtggtggctcatgcctgtaatcccagcactttgggaggcccaggtgggtggatcacctgaagtcaggaattcgagaccaacctggccaacatggtgaaaccccatccctactaaaaatacaaaattagccgggcatggtggtgcgctcctgtaatcccagccactcgggaggctgaggcaggagaattgcttaaatccaggaggcaaaggttgcagtgagccaagatcgctccactgcactccagcctgggcgacaagagtgagactctgtctcaaaaaacaaaaacaaaaaccagaaaaacaaagtagtaaaatccagaagatagaacttctacaaatcaaccaaactgaaaacgcaatataaaaatgagcaatggctttcatcatcagaagagaaagaaaactcactgatcttgcatgcccccaaaaaaagaaaggaaaataaaagttaaccacaaaaaattataatgtaagttaaagtacaaatgaggggtcatttttttactcatcatattggcaaaagttaagacattgcaagatataatcatgcactgcataaggatgttttagtcagcaacagacttcagataagacagcagtcccataagattataagactgtatttttactataccttttctatgttaagatacacaaatacaaaccattgtgttacagttgcctacagtattcagtgtagtacatgctgtacaggtttatagcctgggagcaaaaggttatatcatatagccaaggtgtgtgtggtgggctataccctctgtttgtgtaagtacactgtgatgttcacacaaggatgaaatcacctaacgatgcatttctcagtgcgtatcctggttgttaagtgatccatggctatattcagagttggtgagagcgtggggaaaagggagtccattgttcgttgctggtgggagtgtaaattggtttaatctcttaggacaatttggccatctacacactgatatatatgcacatccttggacccagcagttgcactccagtgtgcaacaggatgaatggttacagatatcatggtacattcataagacagaatccaatgcaattcaaagaaggagctggatctatgtgtcctgacattgtaagtatatgtctgaaatacttcataatacttcttaaaacccgacaggtttatttttgtttctaatgttatattctgt

SEQ ID NO: 841 - DNA, 2604 bp, Homo sapiens
gacattcggagctgctcttcagggttctgggcacgtcgcatattgcgccccagccttctcagcagccaggagctgggaggtggaggggcctgtggtctggccgccacctagcaggcctgcatggccacctccagccgggtgcaggctggctggggtggggctgcccttgaccttgggctctccctcctccgccagatcctcaggcgctggctcagcctcccacggcctgggggagcctctgtctgctccttccagccgttcaaggacgaggcttccgaaagactcactgttcctgtgtggggaactgaggctgtgtgaaggctggatgaaccgctgctgtggcctgagtcctccggaggctgagagcaaacggctgcactaggaacccagcagtcagaccggcccccaccctggagtgaacacatcgccactgccaggcatcgcagggaggattaccccaatggcacctggctgggcgacgagaacaaccccgagatgcgggtgcactgcgccatcatcccctccgacatgctgcacatcagcaccaactgccgcacggccgaggagatggtgctcacgctgctggactacctcttccaccgcgaggtgcaggctgtgtccagcctctcggggcagggcaagcacgggaagaagcagctggacccgctcaccatctatggcatccggtagccgatgatgagcaccccacctcctgccagagagctcctgcagccacagctgcagccgcaggccctgcactacgcgctggccaacgtgcagcaggtgcagatccaccagatcggagaagacggacaggtgcaagtaggacacctccacatcgccaaggtgccacagggggagcaagtccagatcacgcaggacagcgagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaagtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctcatgtaagtgatatttattttatttatattttttgagtcagagtctcactctgtcacccaggctagagtgtgctgacgtgatcttggctcactacaacctctgtctcctgggttcaagcgattctcatgcctcagcctcccaagtggctaggactacagacatgcaccatcacgcccagctaatttttgtatgtttttcagtagaggtggggtttcaccaagttggccgggctggtctcaaactccccacctcaagtggtctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggag

SEQ ID NO: 842 - DNA, 1131 bp, Homo sapiens
ttatatcaatccttcacatttctttgatttatgaaagaaaaaatgttgcaacatatagaagatcagaggaaggaaaggaggaagcagaagctagaaaaatctagattgtcttcatgagccagacagaggatggcagaagctggcccaagtctggagctggctgaagatgaggccaatctctttgcagcaaagcccccaaagcatgtggatcatgtggatggattttttcactttctgccttgtcatttagtctaacaactgagactcagatgagagctgagtaaaaggtctcagtcaggccacatgaaccacctccacctccactaattcaaggaagaagaggtgcaaaacccatgcccacctgtgtaaatgctgctgcaggtttgatagaaaatcatgctcagtcaccagctataggcaatacacgtgtctctgtgagctccatccccacacctcctccaccaccccttccatctcccctgtcaatgtcttcattaggagcttcagtgacttcaactgctctccaccaagacctctcccacctctgcctccacctccaaacactgccttgggaactccagcagtaccacctcctccagcgcctttccacattttccccagccatcttcacccagctcctcttccagctgctcctctacacagccctctctgccaggaattagtgctgtcccagttcatccatcccacaagacatccaaggctacctccagccccacactaccttctctggctccacttggtattcaaccatcatcatctgtcacagttgcagtcctgctcatcctctctctggctacatccaacttcacctactgctgtcccaagtccccaagctccatgaatgaccccaactcctccaacacaagttacgtctgcttatgagccgaagtgtcatctcccagctgtacctatagtctgggttgccaagagtgtacttctggaagcagtaaggaaaggtgttcggttacacaacgtagaagagcagggtgtaaagagagctcaccatgaagacattgaaaatgatgttgccaccgtcctgtcttgccatactgctgtggaatctagtgattcagaaaatgtttccaaatttgatgaagtagactggttgga

SEQ ID NO: 843 - DNA, 4661 bp, Homo sapiens
cgcacgtacgcacggacgtcctcccgagggaggcgggaactcggttcgcgggcgcggagcggtcccggaccctcgaagccagttccttgcgtcagtgccgcggctctttaacccgaagggagattttttttttaaagccagaggccgttgacgctgggtagcctttggctggggttggttatgaactccgacacagcggtggtgcatacggaagggtggtagccgggacggttccggtccctgcgagcgtgtcccgggcgtctccgcggaagtttcacctgccgcgccgctcgatcgccgggacctcctgggtctctgctgtgcgtagaccagccgcgttcctttgggtggccgtggagcactaaagcggggcttattgtttgtttggttttggtttttttttttgttttttttttgctttttgtttttgaactgaggatctatcagaaataggctgaaaagaccgagtgaggaagaaactctttaacagctatttttggcatcttaaggtgattctcaggagttgctacgtatcagaatcaacggaggagtttttcaaagcagagatgccagggccagtccccagacctgaatcaggaagtgagggagagagccgacggagggggaaaagtcccttcagctgattcttatgtatgtcagtttggagagccacggatataaccaatactgcgtccttctgaggtcccactttaagtgtcctgggttgagctgggtgacaaatgcccttacaacaatggtagtagaagctttcaggccaagcgcagtggctcacgcctgtaatcccagcactttgggaggccgaggcgggcagatcacttgaggtcaggtcaggagttcgtgggcagcctggccaatatggtgaaaccccgtctctactaaaaatataaaaattagccgggtgtaatggcgtgcgcctgtaatccgagctactcaggaggctgaggcaggagaatggcttgaacccggcaggaggcggaggctgcagtgagccgagatagcgccactacactccagcctgggcgacagagcgaaactccgtctcaaaaaaaaaagaaaagctttcagaaagttgcctttttatttgaaaaaaaaaaaaaggtatttggaggattttatgtagtgcaacaactgttttagtgttaagatcatgaaatgctttggtctcctgttagtgttcccaagaaaggtgctgtaagtccttaaaccacgtgaaaactttttttttttttgagacctcctcgttctgtcgccctggctggagtgcagtggcgtcatcacatttcattgcagcctcgacttcccaggctcaagccgtgctcctcgcaattacctgggaccgtagatgcacgccaccatgacttagctgatcttttttttccctttgcctcgaagaggctggggtctcaccatgttgcccaggctgaaactcctgggcccgagcgattggcccgcctcagccgctggaaatgctagcattacaggcatgagccactgcgcccagcctcctgaaaactttttaaaatttattcaaaaatgtttcctgacctctttattgtcatagtgttttagagatacactgggattacaaaacagaggagctccctgcattcaaggggtttacaatctaatagagaaaaagattgagaatagatacatgccagggagtggtaagtgctgtgaagaaaagaataagtggggtaaaaggggttagaggtgattgaagaaggcccctgttgatcagatgaaggaacctgtcttggagaagagcaggagaggaacacataacaagtgcaaagggcctgagggaaacggattcttggcttgttagaggaggagtcagtgtggctggagtggcttgaacaagggagagaatagtaggacatgagataagagagttattaagggagccaggtcatgtacagaaatggtcttcaattttttttttaacttttgtgccctttgaaagaattttggaaggctgttttctttcctcaaacattgtaagttgactaaattttttcagaagtttaaatagttgcagagtttaatttgtgacattctgtaatactgacatttaaaaattatttttaatctaatagggaagtaaacactaaagtggcttaatactatccattttttaaagtatattaaaatgttatattttttaaacatggaaaagtattgggaatgttttaatgatatggctgggagtcttcccccttcccctaattatttcgagtaggcatgaatgcatataacattgctagaatgagataaggtcctgtatcaactccatttttcattgccacagtctttactgcattaaaaactatatatgtatacatgtatgtatctacacactcacatatatgatggagtaattcccttaaaactacccttacttttttatgtaccccttggaaaattttccttcactgaagtaccccaggagtactcataccctagccttaggaccactgagtcagataggaaggcttggatgggttttgagcaaagactcaaagcagaattgtgaaaagagtcactgtggctgcttcctagaggaatcacctgtaaatggtcagtggaataaggaagaccagttaaggggctaatagggtaataactcggttggttggatcaggttagaatctgtaaaggtggtgaaaaatatggagtataaatcataaacacttcttctcaaattcacttcaaaaaaataagctaatgaactgaatttctcaaccaaaagttttgcttccatgagttttcttaaccttttgatgcctgctacatttgcctttattaaaatctagaataaaagtgttgtttttgaaaactatataatttgtataggatggaaacagcccccatgaagttcactgtgtgctctgagaaggcagtgcctggagtataactcatgaaatatttaggatcattgaaacagacccagttacatccttgattttctgtgggagcccagaaatcttgcaggagaaactatgaaataagtccacagatgaggctgagatacgataatgcacaaacctgtctaatagactgcatagcatggggttcattatgccctgggacaaaatgcttggtttgaatctggttccatcacctactagctatgtgatttagggaaacttacttaggttgcctcagttccctcagtcatgaaagggtgtttgctacgggtaggacctacctcaaggttgcctcacaaacaatatttgtaaaacgttaataacagcacccagcacatggtgaacatggatgttaaagtagacccaaagttccctgaaggaaacagaactggcaggagaaacacatgccactgagagaaaatttcaagaagaggaatcatgctgtggcccaaactgagcagcaggtagaggtagaggctgtgtccagccattttcctgacctaggctactatcccttgttcctctggtttgagcattatcagaaaaaaccagttctgaaataaaggaaagagctcttaggaggttcatagcagttctgctatgaagaaaactcctctaagttgctggtaaacaatagtggaaggagttttccagttgtctaggaaagagaaagggcattggaggtgagtgacccaggtaggtaagcaatggtgagaacacgatgtgtccatcatctgggcacaggaggttggcaaaagcaaggcagtagcccaagggtagcgtgaagatttgcaaaggctggtctgcaccttctggacagagcagccatgctgaacagcaggaacagaagagtacatgagaaccggcagaaggatgctgagctgcagctgaaatctgggatatttctgtaaatgtacaatacttgcactcaccaatgggtgaggccagaggatctaaaggtgacattttatcttttaaagttcacttctcaactgggtgtggtgccttacacctgtaataccagcactttggaggaaaacaggaggatcactggaggccagtagttcaagaccagcctgggcgacatagcaagacccccatctctacaaaaaaaatttattaatacaaattttaaaaataatgtaaagtttagttctcatcattccatggtgtaccaagtacactttgacttctaggtactctgttgtctgagtgagaactattagtaccaagaaaagcaggacagatagcagagttctgagtctaattactatctattggcttttctgtgtctctaaggcctttcaggggcacgttgtaattctagtaataaacaccacatttgaacagcagtttacagttgacaaagtgctttcacacacatctcttaatttttgcaaccagtaaaatatagctcaacaataaatagacttccttatgtgaatgtactgtaatgtattatctattcatagacaataaggttttcaattttttactattataaacaatactgtgaaaagcattgtgatgcataattatttgcatatctataattatttcttctgaatattcctaaaagaattgctgattcaaagaatatgcccattgtaaaagtttttaatatgtaaatttaaagtattccatatggattattaaattgttttgatgtattttgctactataaataaaaaagtgaaattaacatgcaat

SEQ ID NO: 844 - DNA, 1020 bp, Homo sapiens
atattcaatatgtaatcttgctgaaaactcttaggaaaatgggaattggtgaatacttactctatcgggggaccccaacccctggttgtgggggtaccggtctgcagcctgttaggaaccaggcctcagagcaggaggtgagtggtgggcgagcgagcattaccacctgagatcagcagcgccattagattcccaaaggagggcgaaccctattgggaaccttgcatgcaagggatctgggttgcatgctcctgatgagaatataatgctgatgatctgagttggaacacttccattcccaaagcatcacatcccccccactccccattcgtggaaaaattgtcttccaggaaactggtccctcatgccaaaaaggttgaggaccactgcagatgataaaatatattaaatccaccctcacacctaagaggatgcatgcatattggttcagtgcacagacttggggctaaatgtttccagattgtggcacacacagaatatgggcttctcaggctggctcagtcccactggtcaccctggggccagaggtcagtacccatttgcaactctgtggctcactgggtgggaaacgctggtataaagaatgacaaacaaacaaacaacaacaaaagaccagcaactcagcagaaaagcagacaaaggatatgaacagacaattgataaaagaaaatagaaataggctttaatatactcaagctcattaattataagagaataataaatgcaactacctatcatattgccaaaattccaaaagttgaatgacacataatgttggtcacgggtggggaaacatacatttaattcaatcccaattatattgttaacaaatttggagggagcggcaggtgcaggcaggaccaggaaatcctagagggaaatcaaactgaaacagtgtctttaggggggaaacagaatagatatcaacattatgaatgcacactcccgtgatacagaaattctacttccagaaacttactctacaaatgtttacgtaga

SEQ ID NO: 845 - DNA, 3370 bp, Homo sapiens
ttttgagacgtttcactcttgttgcccaggctggagtgcagtaccgtgacctcagctcactgcaacctctgcctcccaggttcaagcgattctcctgcctcagcctcctaagtaacggattacaggcatgcacaaccatgccccactaatttctgtacttttagtggagacggggtttcaccctgttagtaaggctggtcacaaactcctgacctcaggtgattcacctgcctcggcctcccaaagtgctgggattacaggtgtgagccactgctcctggccaagggcagaaactcttacaccttgttcactgctgtttcctgggcacctattatagtgcctggtatatagtaggtgctcagtaagtgtttgttagggactgatgcgttggttcaagcctgtaatcctgttgctttgggagatgggggccagaggattgcttgtgcccaggaattcagggccagcctgggaaacatagtgagaccctgtctgtagaaaaaataataagctggccaggcgtggtggctcacgcctgtaatcccagcactttgggaggccaaggtctgcagatcacctgaggtcaggagttcaagaccagcctggccaacatggtgaaaccccatctctactgaaaatacaaaaattagtcgggcatggtgacacacacctgtaattcaagctactcgggaggctgaggaaagagaatcgcttgaactcaggaggcagaggttgcagtgagccgagatcatgccactgcactccattcagcctgggcgacagagcaagactccgtctgaaaaaaaaaaaaagaaaaagaaaaactaataaacttagccaggtgtggtgttacatggctgtaatcccaactacctgggaggctgaggtgggagaatcacttgagcccagttgatggaagctgtagtgagccataatcacctcgccgtacctcagcctgtgtgacttagggggactctgtctcaaaaaaagtaaaaaaaagaaaaagaaaaaagaaatattcattggggaaaagaagagtgaacaagcaaagtttcaggagagtactgtgaatgtgggtcatgtcagtaaagtgtagggacttgggcaggagcggctggacttgaagagcaggttggtggagaccaggtcatttatcctaagaagtttgccctgtagcatgtagattaaatatcccacgttggctgctggcaactgaactgggcttcctgtttctgtgtttggtttgaccatcacagtgttgaagaactgttgaagtgaataccttgcagtttgctacagtttcccccggtctcccacattactctggcctccttacctcatgtaggttgcctgaccctctgagacctgtgtttgctgttcctgcagatgggtgggtatgaggtgatttaaggaggaagatttaatatatgagttgtagaaagataaatagactgggcgcagtggctaaagcctgtaatcccagcactttgggaggccaaggcagaaggattagtttgacccaggagttcaagaccagtctgagccacatagcgagaccccctctctacaaaaaatttaaaaattagccaggcatggtggcatgcacctgtaatcccagctactcgggaggctgaagtgggaggatagctggagcccaggagttgagaaagctgcagtaagtggtgatctcgccactgcactccagtctgagtgacagagtgagaccctatctcaggaagaaaaaaaaaaaaaaaaaaaagcaagagagataaatagatccaccattagtgggagtgtgcttttgagtgctctttaggagaaaaatttattttaatattttttcttctttatattttttatattctagcaagccatttcttcaacaaggagaaattaatttcatccaaagagccctaagagcaagggcagactcagaaaatcagaggcactgtagtcagtttgagcagcttatgtcttcagactgctaagctggccagtgccaggctgggtccctttaatttctcaaacacaaatcgccctgctggaatctcaagttggatctgcagtagatcaccattaactcagcagcttgctttgttgtgagtccttatgccaggaactgtgcgggatacaaaatgtaagagaaggctggaatagagcatctcctggggaaatgagagccagagatacagcggtgccccatggagacagccagctggtgtttggtagttccttgtggaaaggctgtactttggtaaggtctccatatctgcagtgtggccttcaatattgtaggtccccaaactccaggtttttacattcgctgcatagctcagggtcgtagggagtgattcatcctagcagaactctggtttttaaggcaggcgttccatttattaattgacaaaggaggcatatttctcctttagtaacctgatgatttaggtcctttcttcagggactccctttccacataaaggttcttggaaaactaagcagagtatgaggaaaaggctgtgaacaagcttgctggtccctccctgtcctaaaaaagagcatacctcttctgtaaccagaaaacccttttcactagtcaaggctgtgcagactgagatgaaagtgtgtgtgtgtgtgtgtgtgtgtgtgtgtgtgtgtgtgtgtggacagggtctcactctgtcacccaagctggagtgcagtggtgagatcagagctcactgcagcttccacttttgcagcttccactttcctcctcccacttcagcctgcagagtagctgggactataggactgtgctaccacacccagctcattttctaatttttcgtagagatgaggtttcactgtgttgcccaggctggtcttgaacttctggccttacgggatcctcctgccttagtctcccaataggctgggattataggtatgagccacttcacctgacctgtgatgagttttcaacaatgtgattcctcttttacagaaccacctaagctaaagattcttttgagaacaagggctagcctgtggtttcatggcctttcttccatttggggttcttgccaagtggaatttaaatgacctcttatcaagatggataaacccaagtttcccagtgctggaatacagaaaatggatggacaagtaagtcccactcagcacccatagcccagacatggggacctcaacacacctgggccccagacatcacctttcattgtgggtagctcagagatgacacttttggttgttaagtgcccactggcaatagtttctataacagcaagtgaaggaataaatagtcaccaaaacattttctgttcccaattccaacattaattgggtgagataattattttatgaagaattgtca

SEQ ID NO: 846 - DNA, 9378 bp, Homo sapiens
aaacagcacacctcttggtttatttgtattcatttcatcagtttcaaggaaaatatgttgggagttcctcgcatagagaatgtcacaaagacatgttttcaatagtagtgctatccctagggcagagaagacccagagaaagcccaagtggctgctggaacacagtcagacaccgtgccacctgtccacactccttggctctgccatcatgctgaagatcgctttaaaggactggcttccctccccccaaaatgaatagagcacagactgagaaactgaatgtgggagacagcagtggattatgctgttctcaggggtcacctcaggtttggaagcattctttcaaattaacccatctcaggccatctgcagagaagaaaggtggtacctaacttttttcttgtcagcatttggtaggggtgttttattgaccaaatatgttcccacaacctagttttttgtgagtaactaaatatagtagagttttaaattttatcatcaaaatctatagacaatttttgatgaaaatagactccatctctatgtcctgcttttcttcttcttattaattacattgctgtataaaagaacaagacttcagaatcaagaatatcttgtctcttggcattgaatttatacaaggtgctctttctttaatgctgtctcaaaggacatatttttactcattaaaaaggaagatcggaatctagttgtatgcgctgctccaacatattaataattaaaattaggaggtaaatgtggtcaaaactatagaaagactgagatgtcatttatattgattgctgtatagcattctacaaacagaaattgttaaataagtttatataaatattttgtagcatttcaaatatttgagtgcttgacgtttctcctcttctatagttcagattatcaatttgaagacttactccgctagttaaaatgtttttagtctcgttcgagtattatataaaagcaattttcagttaaatgtgttccgcttacatacaacattacaaattattgaggatttaattacttattcatgttcctgtaatatctttagaagattttcttattattacctatcaatatatgtatgctttgtcaaagaaaaatcaaacatatatatcattgaaattgaaactttttaaaagtacttattaattctattgaaaaaccacatccataggaacaattacaatataatattgtgaacatgtaaacatataccctatgtctattttatgtataagcatgtatgattaaaaatatagtgaagaatttttaaacctagtattataaagtaaaaattagttaacttctgatgattatttgttaattaagataaaattattttgatttgggtgattttaaataaagaaaaatattaaattacatgacaaaaattctttataaaatgtttatgatttttacattggttttatcactttttccactattttattttaagatgacctgccttgtttaaaacactgtattcatcttaattaaattagattccatttgtaaaataattaacaaatgatttgctctattttacagtgcggttataaactgagtcagtatctcaagatttgatccccattatcatcatctgtggccctatttgttttataaatgtattgtctttttccatgcctgtcacatctctattgctttttcatttttctctttgtcccttatagggagcattgcctatctctagattaagcaaaggttgcatcataaaaaagcacaataacctgctcaatctttctcacacagagaaatgtttgttaagtaattaaagtgtagatgatgatacaaagaccttgattaaattagataacaaagtacccttgtgattcagaatatgaatggtatttaatttctttgaaatcattaattgctgagtgacattaattaatgccaattttccagaagatgttctagttaatgaaatgtatacaacgaaaagcacaataacctgctcaatctttctcacacagagaaatgtttgttaagtaattaaactgtagatgatgatacaaagagcttgattaaataagatgccaaagtacccttgtgattcagaatatgaatggtatttaatttctttgaaatcattaattgctgagtgacattaattaatgccaatattccagaagatgttctagtgagtgaaatgtatacaacgtgcaaaagattcagaactctgaagggcaacattattctataattaagaattaagaattaattcacatcagttattggggagaaataatttttaagaattaatgactgagaaaatgttattttttacttagaaaattattttgtgcatgagcattaccgcaagttttgcaagaaacataaatttaaagaaacaattatgtgcacaagatgaatttaataacatcttgatatattccatgattgcggttttatttggtaaatctttaaatgcacaccatttaatgataataaatgaatcttggaaatcttgtaggtaagggtaaatattaggatgcatccagttacatttacacacacatacatgcatacagactgattcacgtgtgtatatatatatatatgaatttaccaattgatgttaactaatatttataagagccagttggattgatatatattgttgaacctgaaaaatatttattatatacatgtttaaaatacacacagaaataaatagcaattgcactaggtatttgaaactgtactaaaatataagctgtgaacattttgtgatcattacaaattcttacactgaataaatatgtttatttttacaatattaatatgtttgatacctgtgtacattttttacaatgtgttattttatttttgtcatagagtcatgtcatgcataataacattttagtcaaagatggattacatatacaaaagtggtcccatgagattataatatatatttttacatacttttctacgtttaagtatgtttagatacataacctcttaccactgtgctcttattgcctgcagtattcagtagagtaatgtagtacacagatttgtagcctaggagaaagaggctataccatataacctaaacgtggtaggctgtacaatctaggtgtttgtaatattctctgtgatgtttgcaaaatgatgaaattgcctatgaatacatctgttaaaacgtatccctatcattcagtgatgtgtgactgtactaaaatgctcaatgtaagtttcaatgccctccataaaattgttgtactgtgaaatacaaatctctcacccatggcctgaatatgtttgcaaactaagcagatcatgggaaggagaatgtgctggcatcgctgggatgattttctcacactacatgaataatatctacagacttcgtgaatatgagccacttgcatagagttaaagtagacgtctctttgctgggaaatttatcaaatgggagtatgaagtgtttttacaagatacttgtttgtttgtagctggtaggcctacagtggctcatggcaatggttgaggttgctaagatttggtggaagaaggcaaaatgagatggccacttatatggtatatggatcacttgtttctgttgagttacaaactcagctggctatttctccaatgttagttatttggagaaaaaaaaacgtgatggtaattttggggtaacaaatacaatatttgatgaaagcaaatttattgagggttagacaaactacaagatactttaggctgcaaagtcaacacgagacttctggcccaaattgtgaagagtttgcgtccagctgcacagttcaaaggaagaggccatgtaagaagattctcacttctgacaccaactgccagttcaggggtttcccctgaacaccctcagtttcaagagtttactagaaagactcacagaactcattgaatgccactgtactcatggtttataatagagaaagggtagaaattaggaccaatagaagagacatatcatataaggtggaatctaggagattttgaatgttaagtttccattgtcttcaggacatattacctgtcactgttgtacagcaacaaacatggagtactaccaacctggggagctcacctgatgctaacaagacactatttacaaaatgaaaagacaaatgaaaggatgagataagatgacgttccacattaaggcactggaacgattagcaaactaaacctaaagcaagcagaaggaagaaaattaaaattagagaaattaataatttataacaataatatttgttagtgttgaataattgatattacttcttgactagcttttttaaaaaagagaaatattcacttcccaatttattctgtggggccagtgttactttgatacaaaaattagtccaaatagcatagaaaaataaaactactataagtataaatgcaaacttccttaaaaaatactaacaaatcagatctagcaacatataaaagaattatacactatgacaaagtgaaatttatacaagtaatcccaggttggtttaacagcccaaaatccattaaggtaatacatcttatccatagaataagaaacgagaattgcatgatcacgtcgatagattcggaaaagacatttaacagaatccaaatgctttaatgactaaaaataaaaataaaaactcaatgaaccaggaatagagaactttctacacctgatatatggcacctgtgaaaagccaacagcaagcatgcaacttaatggtaaaggatgctttcccgctatggtgagagatatatactttgataggatatatactttgacctcttctagtcaacactgtactaaagattttatgcagggcaaatcggcaactaaaaaaataagagtcacccatactgaacaggaagaaataaaactttatttgaaaataacattcttgtatatagaaaattttaaggaatccaccgaacgatagaactcgtaaattatttcagcaatattacagcaaacaaggtaaatgtacaaaaatcaatttcacacatctgcaatgaaaaccccaaaatgaatttaagaaaacacttcaatttaaaatagcatcaaaaaaagaaataataattaatttggaaaatgtgatacaagattttcctctgaaaattaaaaattattgtttaaagaatatttaaataattagcaaacaccttacacccatgaattggactatttaatattgtagtactttacaatttgaactacagatttgatgaaatccctgcaagtatcccaacagacttctgtctagaaactgacaagctgattctaaaatacacatggaattgtaagggactcaaaatagccaaaataatcttaagaaaagaaaacatgttaggataattcacacccccatgctccaaaccttactgcaaagtatcggtaatcaagacaacacaatactgatgaaggaaaaatatatagattgatggaagataattgagagtccatatataaaactatgtgtctacagtcaatggattcttacagtggtaccatgtgcaattcaatgaggaagagacagtctttgaacaaactgggtcaacaaagtacacatggatcaccacttgcaaaataataaattcgaacccttaccccaaagcatacaaaaatattaactcaaatgaattaaagacacacatgcaagaggtagaataaagcatatgggaaagtcttcaggattttggatctagcaaagaaatagctgtaaccccaaaaacatgagcaacaaaataaaaattagatatttaaaatttcttaaaaattaaagacattggtgtttcaaaggacaaacaagcaagtcaaaaggcagctcaaaaattgtgagaagatatttgaaaaacacgtatctatatgtctgtatatatatatgtatcttgaatatagaaaaattgttttaactccgtcacaaatatcccaactcaaaactgataaatgataggaatagatgtgtttcccaagaagatacacgaacggtcaataatcccataaaaatatactcaatagcatcactcatcaggcaactacaaatcaaaaccacagttagatactctatgggtagaactggccaccttggaaaataatttgatggcttctaaatatatgaaacatagaattgtcatatgacccagaaatttattcctaggtatacacccagattattggaaagaggtgttcaaacacaaattgtacacaagtatttttagcagcagtatttaaaatagccaaaggctgaacacaactcaaatgtcaataaaaatattattggataaacaaaatgttatatccaagaaattgaatgttatacagttataaaaagaaataaagtaccaatacgtacatgaaccttgatagcattatgccaactgaaagaagccaggcagaaaaggccacctattgtatgattctatttagatgaaaacagactaggaaaatctatagagacagaaaacagatttgtggttgcttaggattgagtaggggatgggtgcataggaggttaacagctagggaaggtggggtttctttttgaagtgatgaaaatgctctaaaattcattgtgatgatggctccacttatctgtgcatatactaaaagccactgacttgtagacattaatgtgtgcactctacactatgtaaattatatctcaataaatcctttcaaaaatacacagaagagtaaggggttttggaatgctgcagctgggaggcagtttgaaatactgaataggcctcatcgagaatgtgaagtttcagtaaagacttgaggaagttgaatgagctgatcaatggatatatggagggctatctttccaagccaagaaattaactagagtcttgaccataaggcagcagcatgttggcatgtccagaggacagtgaggtggccaggaccactggtaagatcaagggtgaagatataaaagaattttggcagttaacatgtggcagatgatgatgggcttgcagatcattgtaagaaatgttgttttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaagaaaaagaaatgttgtttttagtgtacatgaaatggggagacaaatcattatcccattatcaatattttaataaattggatccatgaaccaaatccaatgagattaaatcaattaataataatatgcaaatttgtattaaaattaaaagaattacttgcacatttgagaacaggagagacatgatttttatcagcaataataaacattattaattttaattgtgatcagctaattgagattaattgcaatacatcatgctttataatgtgactgccaaaaggaaaatatgattgtaatcttatactacatctatcaatgtcttttatacataagagtatagagtaagcccgtagttttcaaagccaacctatgaagcagtgacatcttatgcaagtttgctgctttctgccacagtgatccttggtcagcgggcacaaattgttttacaaacgccccctaggtctaaaagtagtttggatcacaatgaacacagaaacaccttcatcccttcagaaatacctatcaattacttccaatacagaatgaaaaattgacaaaggaaatatgtggattgtaaaaatgccagttagcttgcaactacatgaaagaaaaatgccatttttattacattaggtcattgtttcacatgagttttggtatagcaaaatgttgaaccaagggaaaagagacatgaattaatgaagtcttaagatatcaagaatttgaaagaaaaggcaggtcatctttgaaggttagtgacatagcattcatcttctgttgtcacctttcctgtcattccctgtatgcctgatggacaggtttcactcaagttcagagaacagcatgcaaaattagctatcaattaatctttaggaagtgagctgcatttctagccagactgagcttacgttttagcaggaagcatttttgggaaatgtttatgttagagttggcccttcttgacaaggtgagacataaatgtctactttatagacatgaattaagatgggaagatatttgggggaatcatttactcaaacgctaaataataaaggtacacaaagggcaaattatactagatttctttcccacttgttttctatgtctcatgcaattcaccttgattcccttcagtttctgtttaatgtagaaagtggcattttcattattttaagcttctagcacaatgaaagaatttctctttttcatgaacaggatcatacatgaaaaggaggaagagtgtcctatatcatatttattgttcaacaaaacactgctccacggcttaaattcagtttaagaaagagaatttgttgaacatctaacacatacataaaaggcagtaaagacacatgagaagagggcaggatattgaagtatacagacttcaatgctgagttttatatcttagggagttactccaccttacagaggctcaatttcccctgatttaggaaggcgatgctaatgggtattgcataggtgtaagtataaaaatgttgtattgaagagaatcccacaagcttggtataaggccgaaaataaattgatgtgacatgaataagtagtttattacatttgtatgctacctgcagactagaggaagcaagaaacacagccactatgcttgattagcattatagggatggtacaatgattgttgccagaagctggagggaggaagaaatggggaagtattgtttaatgggtatagagtttcagttttacaagatgaaacgaattatggagatggatggtagggacggctgcacaatgttatgactatatttagtaccactgaactgtacacttaaaatggttaaccgagtacattttatgttatgtgtattttaccacaataaaaaaataaaataccttaggaacattttcatgaaaaagcccacataaaattcattttaatgcacgtgtttatgcatagctttctatttttctcttttccctttacattcctaattctaatcagagaagggaatcccctctgtacctccaggatattcagtaaagaccactggaggttcatgccc

SEQ ID NO: 847 - DNA, 1342 bp, Homo sapiens
atggattctgatgccctgcgagtcttccagaatgagctcatttgctgcatttgcgtgaactacttcatagaccggtcaccattgactgtgggcacagcttttgcaggccctgcctctgcctctgctcagaagaaggcagagcaccaatgcgctgcccttcgtgcagaaaaacctcagagaagcccaacttcaacaccaatgtggtactcaaaaagctgtcttccctagccagacagaccagacctcagaacatcaacagctcagacaatatctgtgtgctccatgcggagactaaggagctcttctgtgaggctgacaagagattgctctgtgggccctgctctgagtcaccagagcacatggctcacagccacacccaataggatgggctgctgaggaatgcagggtacaaacttataaaggaaatggactatttatggaaaatcaatcaagagacacgaaacaatctaaatcaggaaactagcaaattttgttcattagtggactatgtgtcattaaggaagaggataatcactattcagtatcaaaagatgcatctatttctcaatgaggaggagcaactgcatctgcaggcactggaaagagaagcaaaagagcttttccaacaactacaagacagtcaagtgagaatgacccaacatttagaaaggatgaaagacatgtacagagagctgtgggagacatgccacatgcctgacgtggagctgctccaggccattttttttgcaggactgatttggcacagatgcaaaagccccagccagtgaacccagagctcacttcatggtgcataactggagtcctagacatgctcaacaacttcagagtggataatgctctgagtacggaaatgactccttgctatataagcctttctgaggatgtgagatatgtgatatttggagatgaccatctcagtgctcccacggatccccagggagtggacagctttgctgtgtggggagcacaagcattcacctccggcaagcattactgggaggtggatgtgaccctctcctccaactggattctgggagtctgtcgagattccagaacagcagataccaatatcgttattgattctgatgaaagattttttttaatttcctcaaagaggagcaatcactatagtctctccaccaactctccacctttaattcagtatgtgcaaaggcctctgggtcgggttggggtgtttctggattatgataatggatctgtgagtttttttgatgtttctaaaggttctcttatctatggttttcctccttcctccttctcgtcccctctgaggcctttcttttgctttggttgtacatga

SEQ ID NO: 848 - DNA, 3458 bp, Homo sapiens
actcgatgggagccactagagggaataagatgttctcctgctgtatcccgactttctgaggctctgactccaggaaagcccggcacgagggccttttccattgctgcaggctttttggctcagcactcacttttggcacctctggccatttggcaggaagtacccaaagtgatggccaggcagggccctgatgtctgatgatctggctgccgagcatcatttgtgcagagctccatgtgagagatcagtgaggagctggttgatgggttcaactcctccatcttcctagacaagggttgtctgctcgtgttcttgttgccgtgacagcccttctcgcaccctggaacctccaggcattcgcccctttgctggatctgggatcctcatagctcaggttctcaagactgcctttattgtaaaagaaagaaaattaagtgccttgctttgaagtctaaaggactctcctagggtgggtgttgtagtccattttgtgctgctgcaacaaaacaccatagactgggtaatttatattgtacagaaatttatttctcacagttttggaggctgggaagtccacagtcaagatgctggcatctggtgagggccttcttgctgcatcatcccatggcggaaggcttcacagggcagaagggcaaagagagagtgagagacagcaagagggggcagacccacctccacgatactcacattaatctacccatggtggtagagctctcatgacctaaacacctcttaaaggtcccatctcccaatatggtcacaatggcaactacacttcaacatgagttttagagaagacaaacatgcacaccatagcagtggatccacactgtaaactggtctctcaacttggtgggggcagtggggtggggaatgaggttcccccagatcctctccctccatgccagaagaagactaagcttcaggtagcttagggggaaggtgatgcggccctagctttgggcagttcttagttctgtcttgtgtgaccttgagcagccatttgacatccctaagcctctgttttccatctcaacaatggggatttttttaggacgcactagagtgatgctcttcatacaagctcttaataggggaatgctaacctctcttgctgtgggcactcacatccctcttcacacacaagtccccaaggagttggggcttcctggtctgagctctagctcacgattctcctggtggtttttggtgctgcctctgactctgtgtccttccttgtcccactcagtataaaaatgagttaaccctgcacctgggcgagatctgcacaatgtggaccctccaggtgggcactcaggagcatatggtggcatccctggaccaggcttccagagcagacacataccctacagcaccaccttcctgggaaaccactggttcttcgtctctaccccacagttcctggactgggtattcaataggtgggagcctgtcccttcgacagcacagtggggactctgccaccagctagctgtgtgtctcaggaattttgctgcacctctcttagcctcaatttgctcctctgagaagaaaggtgatacacatgcatcctgccatattctgacagagatgatggacctcaggatcaactaaaaatgtcagtggacttcaggtctagaaggacaggctcctgtttccccagaacagttgggggcatatgggagtctgtggctggggaggggctggcagaaccctggatctcatacatcttaggattcccatgagagggctgaggtctgggggcttcctctgcaggaggaaattagttagtgagagttatggataggatccaagtcccctgggaagtgaaagggaggctggggctcagagccatccccaccacagtcccatcccagctctgcccgcctccttccacatccacccctccagacccaacctctaggggacctagaacaggagctgtagtgagcaacccgctcacacttctacctcaaacctcattcctggtgcaggtagcccttcagagcaagagtcactggcaagacccagcccatgtaggttctatgcctgccctgcctgaagaccagggctgtctctgccaggacagtcacagaggggttgggtggggccgtctctggacaggcagggcaggcacaggggcccacatccaaacaaggtgccctagaagagcaatgtggaaggaaaggccaggtatgtgactctgctgccccccacccccaccccctaacactatctcttctatcctgggcacctggccagaaaagtaccctgagggcactccggggaaggagcctgctccagtgacagcccaagatagaatcagtcccagagcactcctgcccctagcctgggaccatacagaactggcccagtgaggaggtccccagcctcctgggggattctttcctatgctggtggcagagcaattgactctgatggatgcaatgagcgctgggctctcagggcagggttgggacagcctcccctctgggacctttccctgagcctcagtcgaatgatgcgggcccaatcccatctccacctcttaccaaccatatggcctggactagattcttaacctccagaccttcactgtccacatgtacagggcagagatgggacataacagcacctgccacacacagtgactgtgcagaatgagaggagagagggaaggcaggtcagggcctggtccctttgtaggtggagggtgctcactgaggagcagccaggtgcatgggttgcccacttgtgctcaggaaacctcacccacctcagcccttattaggcacctaatgtggattctaagacagacactgaaacaaagctgcccctggggaagacgacatgtatccaaatggggagacagactagatggctgatcaagaaggagacagatgccatctggggagggacaggcataagccactttctggtgcttggagttagtgaggaagggctgagtgaaaatgccactctcctgtgcctaccaatattgggtcctgggtcatcatgtgctgggtgccctcagtgaaccaccatgtgatgcagagaccagagagtgaaggcccgggccggcgcagggtggtgcaactttgaatcgaggtggccaaggtttgctgtgggaggcccagggagctcccgtctgtgtccccttccaaatctcatcttgaattcccacgtgttgtgggagggacccagtgggaggtaactgaatcatgggggcaggtctttctgtgctgttctcgtgacagtaagtctcacgagatctgatggttattataagggggagcttttcctgcacaagctctttttgcctgctgccatccatgtaagatgtgacttgcttctcgtcttccaccatgattgtgaggcttccccagccaccaaccatgtggaactgtaagtttaattaaacctctttcttttgtaaa

SEQ ID NO: 849 - DNA, 2045 bp, Homo sapiens
ttaagcgctcaagttaaactccttgtgacccacataggttagcagaatttaaatcctaggtgattattaactctaatcatacatctaatgacctatattgaagatacactgcctgcttagttgtggcttcagcctttgctccgtcactgatagttctagcctgaaaagcaaatgagccctcatgctcacgatttcaccacagtcacataagcgggaagagcaggctcctggctgtggcgagcttgactccatttggtttgatagaaatgagaggtagatgattccctagacaaatgcaggcctttctcgaagcccctttcccaggacgacgtgacatgagtggtctgtgccttccagggcagccacgtcatgctttgcccagccagggcggtggggagggagacagccacatcctgcccggggctcctgggccccgctgcatcaagtgaaagcagggctggctccctgatgtccttggagaagtcgcccacactgctttcccccatgggagtgacaaggatgtgtcccgccagccttccacgacggaccccccactctctattaattcccaagaaaccaggccatggaggtgggtttgagggtttgtattggtgttttttaaagtcaggttgaccgagtgcggtggctcacgcttgtaatcccagcactttgggaggctgaggcgggcggatcacatgaggtcaggagttcaagaccagcctggccaacatggtgaaaccttgtctctactaaaactacaaaaaaaattacctgggcgtggtggtgggcgcctgtaatcccagctactcaggaggctgaggcaggagaaacccttgaactagggaggctgcagtgagccgagatcgcgccactccagcctgggtgacaagagtgagattctgcctcaaaataaataaagtcgggtttattaagatataatttacatacagtaattttttttttttttgagacagagtttcactcttgttgcccaggctggagtgcaatggcacgatctcagctcactgcaacctccgcttccagggttcaagccattctactgcctcagcctcctgagtagctgagattacaggtgtccaccaccatgccttgctaatttttgtatttttagtagagacaggttttcgctatgttggccaagctggtcttgaactcctgacctcaggtgatccgccagcctcggcctcccaaagtgctgggattacaggcatgagccactgcacccggccagtacatgctttcttgatttgtctgtttcccacctgtctcccctccctagaatggcagctccatgacgacagaggtgtttctctgttttctccatggctgcaccctcagctgctagaaggtggcccagcataggaggtatttaatgaagccttcctctccacttaaatctacacccttgtgcttattaaaaggtgacagttttctgtttgaaaattttattagtgttttaatgagaaagttattatttgggtaatgcctgaatatgaggaaaacattaagggtagaaatgtaattgttttcctatttcattcagtctatggattttattgaagattacagaattacttctttgtagctatggaagtaaaaaaataataagacgagtagctatttcaaaacgtagggctgataaatttgggatggtttgagaacgttaagttggggaactccatttctttttttacatttttatttattttcatttgtttatttatttatttgagacagagtttcgctctgttgcccaggctagagtgcaatgccatgatctcggctcactgcaacctctgcctccggggtataagtgattctcccatatcagcctcccgaggagctgggactacaggcgcctgccaccacacctggctaatttttgtatttttagtagagatgggatttggccatgtcagccaggctggcctcaaactcctgaccgcaggtgatccgcctgcccttggcctcccaaagtgctgggattacaggtgtgagccaccgcgcccagccagggaactgca

SEQ ID NO: 850 - DNA, 1931 bp, Homo sapiens
gttattactatcaatttttaaaaaggccatggcaccccagaaggtacagatcctctgaatgctaagattgtgtttttacagttgtctagtataggacaggcttctcatgtggaaaagaggattcagtgtggtatcaaaaaattgattggaaggcttcctctcttactctctcatacatagacattcacaaacaccatctttgtttagtaaactgtggagactcttccaaaagaaaatagacactaatttttggagaatccattcagctttcacaggcctctaaatagcacaggtgttagaattactaaggataacgattacattaaccaggagcaaaactaaaaatacatcgttctactttcatacttggaaatatcggccttttgatattacaaaaaggccaattttgccaggtccttcgaaatttcaaagaaagattcagtaaaaataaataaataacaggactcactggagccatgatgaaatatttccacctaaaggaaacaatctttaacagctcatccttcagtacactcaaacttctcttgaaccacttaaaaactccattccagggagtcctccaaagttccacaacaccagacgcaagctacccaggacatgtgctctagcagggcatgcccagggcccccagatagatgactgaaaaatataattctttcaggtggacaaggcccagcaggaacgtagtgtgccaggtttccctgccagccctcctcgccctctcggcggggggccaaatgactcaacacagccctgttcgtacctcccttttcttcccatctcccacattataagagatcagagccaagttatccttcacccaaggtcataatctcagattggggagtggtaagtggataatgacaggctctcacagtgaactctcctcctaaacttggcacatcacaaagatttcatcttgcatgctgtccaacctaggcactggctgctggactgttgacaaagagttgagatgaaatccacccttaggagagagcagtggatggattatcagtatattctgtgggctcccaatagtatatatgtctccagtttgctgtccttgtccaaaccacccaaatcaccaagagttcattgagcaattaatatatacaaggcattgtgagagatgcttccaaacctggccaaatatcagagtctttggggagctttttaaaaatgcagatccttcacaatttttctgtaaatctaaagttattctaaaacacaaaagttattttttaaaatgcagatcctttggtttcactgaatcagaagctccccagaagactgtaatatggtcatttagagagctcagaaaccaccatttaagaggctactaagataactaatattaagaccgtcactactcttacccactactcttataaagaaaaccctgcagtcatgcaaaactgcaacacattcatgggtcatcagatcaattttatgggtcatgaccaggatatactcttaaatacaatagagaagttttaggtacattattactttgtgaatcttttctctgagacacatatatatggatatctatatctatctccatatctacaccaatatagatatagataccaatctgtgtactgcatcacaatgaaaacatgtatgttttactttgcggcaaagactaaaaatgtgaaattaaatggtctaaattaaatgcttcctactgcaatcttagtgtcttccctctcttgttttctagtggaaactaagaagcttaccatcaaccacaactctccattaaaaaattataaattgatcttctcttagccttatttctctaacttggaaatgtggaatttccttgcctttttttcatagacaaatgttgttattctttattaaacttcctccaaatggggtttattaaattttagttttaaagtgtg

SEQ ID NO: 851 - DNA, 2559 bp, Homo sapiens
gcagattttaaaaagcgcagtgggctcccacccatcttctgctccttgctttttcactccatctggcgtgaagatcttaattctgcgtctgcacaacggcgttctgccgggcgcgccagtttgctcctagtttttttcttttcttttcttttctttttttttgagacggagtttcgctcttgttgcccaggctggagtgcaatggcgcgatctcggctcaccgcaacctccgcttcccgggttcaagcgattctcctgcctcagcctcccgagtagctgagattgaaggcgcacgccaccacgcccggttaatttttgtatttgtagtagagacagggtttcaccatgttggccaggctggtctcgaactcctgacctgaagtgatccgcccacctcggcctcccaaagtgctgggattacaggcgtgagccactgcgtccgaccttaattttttttttaagacacggggtctcgctctgtcgcccaggctggagtacagtggcaggaccacggcttgctgcagcctcgacctctctgcccgaagcgatcctccctcctcggcctccagagcagctgagaccacaggcacgtgcccccacgcccgcgggcgctcctagtttccttgccgaaaaacatcgatgccacgatcctgcttgcacatacatctagcggtgaagtggctgagggtaagggcatttaaaacggacctagggccgggggcggtggctcacgcctgtaaccccagcactttgggtggccgaggtgggaggatccgtgagcccgcttgagtccaggagagcctgggcaacacagcgagaccccgtctctacaaaaaaatacaaaaattagcggggccccttggcgtctgcctgcagtcccagctacaagggaggctgaggcaggagatcacttggggcagagaggtcgaggctgcagtgagccttggtctcaccactgcactccagcctggactacaaagtgagaccgtctcaaaacaaaaaacaaaaccaaaaaaacctggacatcagtgggggctgcatgaccatcagaggctccagtgggggcatctcccctaaactccgtggcagaagactggaggcttcttcctccattcccagggctcctcctcatccatcagcctctccagccccctctgctgagggtcaagagccttcccaaaggcctgctttggagcagacatggtacttttggttgggtcaatgcaccccttcccatgttttccctgaacagtcggcacccagagcagggtaactgacagcaacgcaaccaggctgatggatcactcttctcagcctcgctccttcttgatctcctggtctatttgtatgttaatctatacagaccaaaagggcacactgcaggtttaataaccttcattatggttcttggctgcctgcaagactttttttccatgttgggcaacatagcattagatgacaccagttagaatttcgtggttacttctttatggcttacccttgaggggttatgtgactcacccaagatcccacagagaggcaaggagctggggctcacctgggtttgtggccagagcctgcaggcaactgtatttacagtgggcagggagggttccctgggccccaggagggagtggggctgggctgttaagctttggttcatgccatgctaacagtggtggtgcctcaggacttacagcctccatcttgcaagcccccaaccttaggactagcctctttcagggctggtctccgtttgagattttgtgagccacctgtccctagggagcagtaaatcagggcagtgagtgtggctagttaaagctgagatgcccatggccaggtccccaactctcttccatagtcaaaaggcttagaaggaagttgagggactggggttcctcatggaaacagcgttttatttcttgggggtaatttataagttttcttagctggttctaggcactaagctaaaagctactggtgactttgaatccacactacgccatgaggtcgataccattacaatctgtgttttatgattaaggagactgactcaggtggtgaaacgtctttccccaggtcagtgaggcaatggcaaaaccgagaactgctgcctcagcccattcttaccttttacccttcgctaccccaggcctggcttgctccctccccaccccaaagcacagcataatcctcctccacttcctgcaaaagcaccgctagaagtgacaacacaacacgccacatcaaatgcttacctcctctgaccagctcgtttctcacggcaagtgacggggccacaggcaggcactgtgcacaaccagatgccatccgtgggaagagggtggagtgcttgatgctgccgcatttggaagatgcttcttagccacgggtttcaatcccttctctacccacacagcttctgttaaggcatttcagccgtgccactcctaatttccgtgtgaactctgtaaaattagaattctttgatctgtaggtctctctggtcaaatgaccaagaaacgagggatgtacaacctgagaaagcacgttcag

SEQ ID NO: 852 - DNA, 1649 bp, Homo sapiens
atccgcctgcctcggcctcccaaagtgctgggattaccggcatgagccaccatttccggcaacaggcagacttttaacacattccttacctaaacttttaaaagggacaaaagatatatgcctttggtttgggagatgacgaaacatatgctttaatgactattgggttggaatcttcttgagagaggatccttcttagcctagactagagtcttcaaaagcccacagtgcttcgtaaagtttcatacgtggaagagagaaggatgttccactggaaaagcagaattgcagctgagctgtcctgaaatgcccagcactctgtggagacgcggaggaggtttcctgggacaaagtgctgaaccagctacagccacaagctgtctccaccatcagatgtggcttacctggttcctgagtcaattccatccagatggtgaagccaaggcctgaagacctttcctgcaaggtcgcagaggaagaggcagaagaaggaccagaacccagctcccctgactccctatccagtgctcttctcatagattacattgcttcagcatccacctggctattgctccatccaggggttacaggagtcactgactgttttggttgcttcttggttggaggatgttgtgcctcaccgatgagagccggaagcaaaggtaccagttcttagaggaagcataggaatgtgtcccttcctgctcgggtctctcaactgaactcaacccttccttgattgattgacaagcatgttatctctcataatccctgcccggtaagggctgatgtccccattttacagatgaggatattggagctcagagaagtgaaatgattgctgaaggtcacacagcctggcttcaagcctctcgggctccaaaaggcatcttctgttctctccgtcaggaagcctcttttggatgattaactgagattaaaaatgaaaagacacatgaaagaaaggtcctttttttcaacctgacaagaactaagaatgcctctgtattccaggcacccagaccagggtgggctggaaagccagccagagagaaagcaggagaaagaaagcatgttctaacaggaaggttaaagcaccctgggatgtgagttggggtggagaagtgaagagggcagttctcacaggggcagagcttggtttggggtaggctaggagctgggaccagaagagggacagggaagggtttattgtgggtccacggcccagctccactgcatgggccatctgacagcgcctgaccgagcagaatgccagggtgtaaagaccccactaatacccagtcaatgagaggaacgccagaggagcacccagaatgttcttgtgcagaggcaaagagcaggagtttgtgaccacagctggcagtccatgtcatcctcactgaacgacctcttagcattccaggtggacaaacatattcacaggtgcccagacaaatgaggtctgcgggagagagacaggctacatcagaggtagactatgtatttacataaagtaggaataagagtctcagaagccttccaaagcagatgtctgcttaaacctcttgagcggtgccctccttagcctggaaggaaggccttgctcaggtagtctcaacccgcatctgtggtgtgatttaacaccttcc

SEQ ID NO: 853 - DNA, 1513 bp, Homo sapiens
ccatgatgtattgttggcattattatccccagtttaaagatgagccaatgcctaaggtcacacaactaggaagtggcagagctgtgatccacattaggtctttgtgtctaaaagcccacgtgtgctctaaactacttggccattcatttctgtgacagactgaaataggtagttcttccaggctaccccaatcatccacgaacctcttctcaactggtagagcaaatgtttagtaagcatatgccgagacaaaaataataggtgagcctgcagcaaaattgtggaagatagcagatggatacatggaaaggaacttagcagagccagtcccagccttgctctgtacacttgccctgcttgccccaactgcacatcggcagctgagtgccgagaggaacacacctggcagctggattgctgtcccatacctttccggccacacatgaacacttctccattctttacactcaggggttggtcagctttttctgtaaaggcccagagagtcagtattttaggtcttggacaccaagaggcagcattgaggatattctgtaagtacttaaaagagaggagtgtccatattattttttaattgacaaaatttgaaataattgagtacaacttttcttaatggagtctattaatgagagggatagaatgctttttaggggactgtttcacttaattggagttcaaagtaagtagttggctatgatcaaaattgattgcaaatgttcatctgttaggttttaatgtatttcatctttgaaaatgtcttttcaggccgggcgcggtggctgacgcctgtaatccctgcattttgggaggccgaggtgggcagatcacgaggtcagagctagactccgtctcaaaaaaaaaaaaaaaaggtcttttcaagcagtagatactgccaaacactgatatcagtccatgtgcgtatgattttagtcaaacatattcatcacttagaaagcatttgtacaattctactagattgttctcttgatacttacctttcagcatgttactgtgttgcagattaatcacattcagttaaaggttagatgtgatctcctcagtttcacaattaaatggattttgtagtacagaaattgccttcacacttgcattgagctctgaaaaacactgctggaactctagtttgagactggcagtgtgtctgctctcaatgtgtggggatgggaatgccattgcttgtaacttttgacagcatgagaactgcataagcagcttgatgttacttgtgattcaagcaacattagttgtcattattcactgaaccttactgcagtatgttttgcatttaagcactgttttgccttgtaattttagggtgaattcatcaagaaacattatcaagcttgcaacaaaataacttccaaagctattcagtgttgaatagtagtggttgagtgtggtttatctcattcagaacaattgcagtctttgccctgagctcaaaacatcacaataaaatttgattgctgct

SEQ ID NO: 854 - DNA, 1615 bp, Homo sapiens
ataatttgggttttgtggaatccaaagaagagaaagcctacccagacttccaacctacggaagctgtgagataaaacattttgggttgttttaagccattaagtttgttttggcagcatagaaaagtaacatatagagatatggattctaatcagaagttctatttttaccactaaaggttaaaacatacttggggtagccttttctcaacgttttactttctttttatcaggagggtttagtcaggacaaaagaaaccattgcaggtatttcaagcaggaaagatttaacacaacatactaggcactttataaacagaaaacaaaaaaaagcgttgaggaaacaaaagtcaggaaaactgcctcacaaaatatggaagttgaaagaatcacagggaatcaccactgatgatctcagttatctgtggcatcacaataagtgatcatcagcagaatgtccggaagccactggtaaaatttcatgtctgcagtattcctgccttgccctgcgggaagaagaataatggcttcttcctcggttctgctttccaaatctcatgtgactgcctctcactggtggaagctaactcagatcccaggcttccagcccctgtactacagagaagagcacagaaggagaaatatggccccgaggggctagcatattcctctatctcattgttcccattgcattgatacccataggcagaaaattaagcaaggaaaaaaaaaggcaagaaaagaaaaggaacaccagccaccaaagcacttagcgatttcagattcagacatttacaaagtgaaattgcaaaagagtttcaattcttctttgcaagctccattctacctggatgagtgccatcaccctgtcaggatattttttctgtgtttatacagaatcatggaatgctagcagctataccttaattctttccttttcaattttgctctttttacaaaggaatggaaagtctattgaggttactgaatactccaagtcaagatagctagttagtaactaaacagggttaaggtcttttgaagtctttctcatttcccaactcactgtcaaggtctacagagtctgagatttgatactacttgcagactaacaagtttgcctgccactgttttgtggatactggcagaagacacaggactcttgggtcagagacaaaagacttcagcactcatgggattgaagttagcctgctactgttttgtggatactggcagaagacacaagactcttgggtcagagacaaaggatttcagtattcatgggacaacagtggccagagcagatactatacatcctgtaggtttgcatcacagtcaaggaagagtaagtttgaataattaactggtttttttcagcaaatggaagcaagcttgttctttgtctggtgagacaccttacctcaatcctcaaggttgctcactgcaaatataaatctcagcaatggcccaactaaagggccttgcattcttggcataacagcaagaatatgcagctgaaggacaaaggcaaattgcgtttcccgacacccaccaagaaagggaggactggagttataattaaaagttataattaaaagtatttcatatttactaca

SEQ ID NO: 855 - DNA, 1849 bp, Homo sapiens
gtctttcgctccaggtagagcttggggttagtacatcactggcctgcgtgctccgctccaggaggtctcggtgattctgccacagcctcatcctccgtcgccctgtgacctactggtattggaacattcatagctaagactccaggacacccacaaagccgagaaatgctgagtttgcgggtcagggcgtccggagactggggaggcctcatcggagtcggccggaaatggcggtggcgggaccgagtctgtgagcctgagcccccctcagctcagccctcagtctcctctggtgcagggtacccaggcgtcctgtaccgtttcagcacagcggctttggccccagcctgtagccctctttgcgcagctctgcgcccgcatcttccccagcttgtgaggtgatgaggagaggttcaccagggaaagacgccgacttggtgtgcagggcttctgcgtggaaggagctctggtctgtggggtcaccagtccctactttaacctattcagacataaacggaggcaccattaaaacattaaagaatttatatgagcaaacagtgatgaaccagtgggacagccccagacatggtttgtcgtttgggggctaccagcgggtcttgaagaaaaggctttaaggtttgtgaagaggcaaagcaaactaaataattgattgggtacagttatgtagtcgtttcatttagagtgtccaggagaaaattttctggttatgtaatcagattaattggagatttatggttggttaagcctgaattttgttttctcctaaggtagtaacttacgagatacgcatttgagttagatcgttttgttgctgttacacaggaacctagatccctagagccacttcagtctacctgctatttaattattttaactttaatcagaagcactgtttttttcctacattttccaaatgtgtggcaagcagagtcttaaatctgttctgccagcctaacttggcttgcagtaaaatcttaaatttccagtttcttttttttttttttttttgtttgtgacggagtctcactctattggccaggctgcaacctccgtctcccaggctcaaggaattctcctgcctcagcctcccaagtagccgggattaccggcatgtgccaccacacccggctaatttttgtatttttagtagagacggggtttcaccgtgttagccaggctgctctccaactcctgacctcaggtgatccgcccgccttggcctcccaaagtgctgggattacaggcgtgagccactgcaccaggactgaaatttccagtttcttttcaacattcaccaaagccaactactcccatccaattcacaacattatcaactatttttgttttttattgtatgtttctatttgtaaatatttcaccggaggaaagcagaaaataatcccattacactccactgtcaaaaatttttctgctttttcttcttttatcttccctaggcacaaatgccttatcaggatatctttaaattcaagtttccctttggaaacttgatgggacagtgtgtcctcagccacactgcttttttttaagtcttgagttttagagctctcttgggataacccaagatacacacaacagccataccttttggaaggtttggtgaatatcagccccttggtcatctccttccagaggacacactgatgtatggaaatggagcttctcaggagagcagctgaatgtcctgaggctgagagaaatatcctggtttacccttcccataaaaagaacctttggggatcttaagattttctttccccagccccagttcttcctggtcagccaattggatggttgtatttagggg

SEQ ID NO: 856 - DNA, 3222 bp, Homo sapiens
ggcagagattgcagtgagccgagatcatgccattgcactccagcctgggcaatagagcgagaaccagtctcaaaagaaagagttaatttttgatgtttataccaaaatatttagcaatctctaatgtattttgagaaggaattatatttgtgaaagaatatagtttttcaaaatgacatagatattgtaggaaatcggaatttttaaaacatgattgaaaacaagatgagtttcactcattagggtaaatggaaaatttctgagtatgatatcagcaaactctaagattcttttaaaataattgtgcaatagtcatttttctggcagagtcaattcattcttctggttcaatatattctagacaaatgaaagaaaaggaatgttgatctgtgtttatccttgtaatttttctaagctttatatacagttttataaatgggatgaattatgtgcacgataccatcaattctaaaaactacctttttaaaaaccttttggaaatcaggattgcagttgataactacctaaactcacttccagccctataaaaattacttttccaaactaaggagcatcacgcattatgcattgtcagccaaagttctgtagtgtcagcgtgatcattcgttgtgtctgtagtgtcagcgtgatcattcgttgtgtctgtagtgtcagcgtgaacattgtgtctgtagtgtcagcgtgatcatttgttgtgtctttagtgtcagcgtgatcattcgttgtgtctgtagtgtcagcgtgatcattcgttgtgtctgtagtgtcagcgtgatcattcattgtgtctgtagtgtcagcgtcatcattgtgtctgtagtgtcagcgtgatcatttgttgtgtctttagtgtcagcgtgatcattcattgtgtctgtagtgtcagtgtgatcattcgttgtgatctacatgctcatatcccttttgtccacaaaggaaataattcgcctttaaatattaacatcatttcccctatgcaattttaagttttgataatgaaataaaacacaatgcagaatgattttgctataggttagatgaccactgtacttgataattgaaaaatggtttatgttcttagacaagccaatgaagcaatctcctgctcttggaacaaacaaaaaccacatgattaacctctcacaagattgacgtgcactgtggtgtagaaagtttgtttgcctttccataacccagtgtatctaagaattacctcggaacttccatttctattaatattacctactaacacttaagtctgagtgtggtggctcatgcctgtaatcccagcactttgggtaaggccgaggtggtcggatcacttgaggtcaggagttgaagaccagcctggccaacatggtgaaaccccatctctactaaaaatacaaaaatgagccaggtgtggtggcgcatgcctgtaatcccagctgctctggagcctgaggcaggagaatcacttgaacccggagcataggctgcagtgagccgagattgtgccactgcattccagcctgggtgacagagtgagactctgtctcaaaaaaaaaaaaaaaaaaaaaatcgggacatgaaaccataagctgaaatgctgccaagacctaaaggaatgaccctcaaactggaatttcagcattttgtcatgtgattaatccccgggagaatgcagtcagctcacatgatgataggcaagtaaccacctttttctgtactcgtactactgttacttttctacaaaatgaaaaacctaaatgtttttttgttttgttttgttttttgggttttttttgttgttgttgttgtttttgagacggagttttgctcttgttgcccaggctggagtgcaatggtccgatcttgactcactgcaacctctgcctcccaggttcaagcgattctcctgcctcagcctcctgagtagctgggattacaggcacgcatcaccacgcctgcctaattttttttatacttttagtagagacagggtttctccatgttggtcaggctggtctcgaactctcgacctcaggtgatccacctgcctcggcctcccaaagtgttgggattacaggtgtgcgcccccacgcctggcctaaatgtttttaaactctcatcctgatcagtatttaggttatagataattttttaaaactctacttagaatattgtttcagaggagtctgtaaataacaaaactctataattgcagtcatagctgatgtatctatacttggatcttttccaaatgctcttctactcttgtaatttctagtctggtcagctggaaataaaagtatccagtaactccacttgtccatctaaaaatataattatttttttaactaacccattaagtattttttatatgtatttattagccaatcatgttatttactgtgactttcctgtttgtttcttttgctcattttctcaacctgctgatttatgaatacacacacatactctagatcttgattcttctgttattttatatataatatccttttcctggagagtagctgtttaaagtgcattcatgatttttctgatactgatagttttcccacatactatcatattatatttggatgttgccattatcactctaaccataaactggtaatctatttatatttttaatagtatgtgagatttctgtgtattcagtcagattatctatgaatggaaatgaattttcttttaaaatcattattatttctttacttttattaaaataaatacgattatgtcaagtattggggtaatagccagtgtcttagttgtttaaacagtttaatggaaatcagtacaatattttaccattcaactaatatttactttgttgtatgcaagtatgctctataattagggctaacttcttatattttttcaaatcctatcacttcttttgctttgttcatatatcattctcctctgctattttaatgttataattcattctgatttcttgttttaaaccatttctgaaatataatatgcttagctgtggtatattattgttttgataagctgcttaatttatcttatgaatattttgtttgggatttttgtccaaatattcaaaattgatattaatattattagcattcatatattaacattcaaaattaagaattttttaaatttttgttattgccattatttgtttattaaaggttagataaaatttggctttaaacccat

SEQ ID NO: 857 - DNA, 5662 bp, Homo sapiens
gctcactacaacctctgtctcccgggttcaagtgattcttctgcctcaggctcccgagtagctgggtctacaggtgcgtgccgccatgcctggctaattttttttgtatttttaatagagacggggtttcaccgtgttagccaggatggtctcgatttcctgacctcgtgttctgcccgccttggcctcccaaatttctgggattacaggtgtgagccaccatgcctggcgccatatagattttatcaatacaaaatacaggatattttgacaggccactttatttagaattggaaacaaaagtttccaaattgtttgaatgtgctaaatgcttttagctttatttttctagtctgaacctttccagtagcctttcagtaagatgtaaatattgaaattaaatgtaatatttactgtggtatataaaaccagaaactccagaactacttgtgttagtcatgaaatcactggcctagagtttggtagcttctaacttctattgccagtactgctaaatcttctttttttttctttttcttttttttttgtgagtcatttggtgaggctcttgatcagtaattttcatcttcagtttgtagatatcttaagtctcaggtgtgcaattagttatacttgaattaataaatttaaggattgaaggaaaaatcacccactgccagctgttacttgtctgattcagtgttttctgaaaaaaaaaaaaaaaaaaaaaaaaaaccaggaaagccttttccttaaaacatttagtttataagtttgcatcttttccatgtctcatcttttactatactaattagtatcacacttaattctcaaattgttacatgtaagttacctttgcctccctaaattgtaaattattagaaccggtgattcttacttattttgcagtcttctttttcccagtgccttgcacaggataagtcaaatttggggtgcttattacatgccagttactattccatatacattgcatgtatttactcattcaatcttgtgagcagctacatgagatagatgcgattatccctcttttacctgaaaacaggattgaataacttcctaggctatcaaagtatgcgataaatactgtgactacactatatttcctcatatgtagtagggttttgaggaatactttttgactgattatcttcaatgtgaaggttttcatttgctggcatttatttccaaaacaaagattcctttaatctatattgcttgtctaaatgcagagtaggagtattatttcatattgtattctacttgtaattatatctcgaattgcttatttagtgatttataacatcttggagaaaaatacagaatattcatgtaaaacaatatttcataaagataattgggtaacatatgtaacaatttatatcaaatctcttgaactcaccacaatctctagtctttttcccctcctgtttatgacaccattgtgcttttagtgtcagagacagtctttgtttcatatgttcaatttcttgccacatctggatgtagcgtatctgtagtgttttctgtttctgctgctgctgttaggttctctttacctaacctttcactaattttaatcttatttctctgctttaatatttgttgcctatttatgacattaaaattttcttaaagtacaactttcatgtgcagaactttcagtggtgttgcattacctccaaaataaaatccagatttcataatctgccattcatcgccacctagtttgatccactcactttcacacattgtttggtacaatcatctactaagtaggctttctctttatcctgtacttacttagacctctgttttatgcccacgtatccaaacttaatttttggccaggcgcagtggctatctcctataatcccagcactttgggaggccgaggcgggcggatcacaaggtcaggagttcaagaccagcctggccaacatggtgaaaccccgtctctacaaaaacaaaaattaactgggcgtggtggcatgttcctgaagtcccagctactctgtaggctgaggcaggagaattgcttgaactggcacccaggaggcagaggttgcagtgagctgagatcgtgccattgcactccagccggggctacagagtgagactcagtctcaaaaaaaaaaaaaaaaatatttatttttattttttattacaggcagttggataatatattgtagaaagaaaagaactatgattcaaacagtttaataatgaaatttcttcaataaatcaagcattattcctctgcaggagttttgtgtacattgtctagaataatctttcccaagctttttgcatggctgcttcattttcacctttgaggctgcctgccttttatcttggattaaatgtattctcttatctaaattctcagtatttatcagagcaccttgtttgtttgagtctagcactttagatattatttggtaatttactaatttattatgtatctcccccagtaaattttaagctgagaacagggactgtaactgttttactcacattatatttgtattgctttgcacagagactagatattaaatatttattaaagatagaaataaggaagtgatgctactttgtattcaaagctttatatattcctagacctttgcttatctgttaaaaacaagacctagcatataacatatattagatgctcagtaaatatgtttaatgaataaaaccaaagttatcttctggaatcataatacatgagttctaatacaccctggtagatagaattatctagttcttatacttttatttgttgttgagatggagtttcactcttgttgcccaggctggagtgcagtgacacgacctcagctcactcctgggttcaagtgattctcctgcctcagcctcccgagtagctgggattacaggcgcccaccacaacgcccggctaattttttgtatttttagtagagatggggtttcaacatattggccaggctggtcttgaactcctgatctcaggtgtttcacccgcctcggcctcccaaagtgctgggatcacaggcgtgagccaccacgcctgtcctagttcttatactttttttttttttttttgagaccaagtcacgctctgtcacccaggctggagtgcagtagtgtgatctcggctcactgcaagctctgcctcccaggtccgcgccattctcctgcctcagccttccgagtagctgggactacaggcgcctgccaccatgcccggctaattttttctattttttagtagagatggggtttcgccatcttagccaggatggtctcgatctcctgacctcgtgatctgcccgctcagcttcccaaagtgctaggatcacaggcctgagccaccacgcctggcccctagttcttatacttttatgaaagacaaagaaggtgaagtgctcccctgaccccccaaccccgaaaaaagcttagtaacatgctgaaggtcacatagttttgttgtggtgacctggcctgttttgtttttaacagcaaagcccatgtgtttttcttgcactttgtttaccgtctgactactgccatttccttaatttcaaagattttcaacttgaatcctcaatttcttcacatgaaaaaatggaccatctagattagatggtttctaaggtctgctgtgattttaaagttatgtagcattgtggctgtatgtcttcacagcagttcaagaatattgcttttaaaggaatttgtagttctttgttgggaaaattttctattattttgcttcctcataagtgatgctcatcttttcaaagaaatacatatacatttttaagtgtatgtatgagtagtatgtgtatttctgtctacaaaattataaaatgatgaaactattctgtcatacctagaatataaaagggaaaaaagtgtgaattctttaaatatttttctatgtcctaatcactggaagtcctatagttgtttcaaactgttctgtaaaatttgtcttgttgcttatgttcaaaatatatttccatgttttagtgaagaaaagtacaaagtggcttgacagaaagtgaaattaagactgctggtaatcctttgaagagacttagtaataggagttggcaaatatttaagagtggcattggagacaaatggcagattcaggataggctgtttctgtaggaagcatggttctggatgagtgctgctcataaagtcattgaaagttattccagatagtttaatagaagtgtttgtttagcaaagacaacagattttgctattttgactgcattgattgtattagttcagatttatgaaagaaagagcccggaatacagaaataagataacaatagaaaatttaagcatgtcaagaactctaatgctggaattgtcacagcaaccacaaaattactgggcatcaatagactcctaagaattaagagaaattgcagaatgtaagccataattgtcattttaggaacattatgctagagcacaagtttaggattgggcaaaagagttgatttttaagattgcattggtgttctctctctctcttttttttttttttttggagacggattcttgttccgtcacccaggctggagtgcagtggcacaagctcggctcactgcaacctccgcctcccaggatcaagcgattctcctgcctcagcctcctgagtagctgggattacaggcatgctccaccatgcccggctaatttttgtatttttagtagagacagggtttcaccatgttggccaggctggtctcaaactcctgaccttgtgatccacccgccttggcctcccagagtgctgtgattacagctgtgagcctccgtgcccaggccagtgttctctcttaaatgtgtttcaatatggtggacatttattgagcacttgtgttgggcgtttcaacaggaggcactggtacgaaaagtagcttgttctagttcatatatcatttgcactttgcttaacttgtataagtactttttactgtttaataaatattttattagaaaatacttctctgatctctcattgatgcccttcttactattttaaccattgtcatctttggacatctgtctgaattgtgggtaagaccttaacctttggagtagagagcaatgctgcttacaaaataatgattgttggtagtctgttcaacagatttgcaatttcaaaaagaaaaaaatgcaactttttcccacatctttcacatatattttgcaaatcttatgcacataattcacatattttgcacattttaaatgtaagatgatttgcatgacaatccccttaagtttttaagtgttagtttattgtagatgcttatgtacacagtgaagactgtaggtcagttttaacctcagccaacatgaggttaaccggatgttcaccttactaatgttctttcgtattaattttaatgcttgttaaatttacattttatatttgatactcattttcccaattcacaaaattggcttattgaaaaatgatgaaaatagtaacaaatatcattcgtaaaaatgctccaatggaaataacttcagtgtgaatacagaatgagaaaatgtatgtgcttttggccgggcacgtggctcacacctgtaatcccagcacttggggaggcctaggtgag

SEQ ID NO: 858 - DNA, 1436 bp, Homo sapiens
tgcccaaaggccagagtcagagcacaattttgaagattacagaaaactccaaagagattgaagagatggaataaaggatcccagcccccgaaaagagaaagctttgtgtctgtagccatagcccttggcaatcagacatcctcctcactaatgtgaggtcaggaggggactagaagtgctcagaggatggactgcctctggccagtgcaggggagaggcaggggtgttgaggcacaggagccagatgagaggaacgtcagcagcaaagcagtaagaagaacatgagagtttcttgatagtaatagaacttcctacacagactgggaaccgggttgtagcttgaggggatgtgacaacatagtggcccggaattttcactttggaaattaactgctttggaccaggaagaagcgctgagcctagaaaggcaggaggcacaggactgtgtgggcttctgtctggcagggacctatgagcttcatagggcgaatgaatcggggcaggataaagcagaggcctccaccctcacagtgctcttagccatctcaggcttcccggaacactgctaccaggctgcctgctggagccctttacactcacaggccttcctgcttgggttctcttctgcaggctgcgtaaaccagtcctgttgtagcccttgtagcatctgctgtagtgatctggtttgggtttcagtattacttgcaatggtttggaaggaaatgggaagtttgccttctaactacattttctttttgattcaagaaccctagcagttctacaaccactgggcctaaaactaaaataaaggaaaaataaataaaaggaagcaaaaacatctaactgggatggcctggcagcattgccagagagagtcctcaggggcccatgcttgttctgtcttttgctctgccatccctagggtggacagcacggaagaggcagtacatcttaacaaaatcagggttctggatgaagggaggggtggtgaatggttgctgcaatcaacagttcatacttcaatggaaagaaggtgggatttgattcctggctgcaaatcttcactctgtcacctgctatctgtgtgccctcagtctcccatcaaggagtgatgtctgtttctccacttcttgaatctgggctggccttgccaatagcatatggcagaagtgacatcgttccatttctgagtcaaagcctgaggaggccttgcatgcttctactctctcttgcaaccctgcactgccacatatcaacaagacttatcaacaagcctgggatagcctgctagatgatgaaagaaatatggcccgcttgctcccatcactccagctgatagccaggcaaccctaagaagcaaagtcacctagctgattagtagctgaccactgacacaaaagtaagatcatctgagaccagaagacagcccatctgag

SEQ ID NO: 859 - DNA, 10870 bp, Homo sapiens
attatgggttaggtgaggaacctcgccctcttctattacggtacgcgcgatgggtattccctgatgccatgaacttacacgtttcacacacgggaccagacgcttgctttagttgacgcatgaagaccggtccggtcttttgcggagaaaagtggttaaaagctgacttgtgggccgagaaactgtggcaccctaatgagctagggctagacgcttcgaccaccacgccaagtgattctgaagatctctaattctgtcaaggcgagagcgctccaacacgtgttcatcggctgttgctttttaaagagaaggcaaggaggaagtcttgcttttcttgtactttttttcctagaagcagcattaaagatttactccttatgttgaggaagcggaaagcctcttcactttaaaagtgtttatgatcgggcctggcgcggtgactcaccgcgcccggcctgctacaccttttaaaattcacagcaatgataaatgtattagactcattgccaggataaagatttaatctatttttctagtagtgccgtcctatgtggttctgtagttgcttattccaactggtatatttccataggatggggttgaataagaaaaacttgcaaactttcagaaacagtaagttatttttatatttttgaaggcttgctgagtaacgcttctcttggtagcactaccttatctacccttcagagactgttatttcttaggagtggccctgggcaattaaaagcaaaaacttctggccgggcatagtggctcatgcctgtaatcccagcactttgggaggccgaggcgggcagattacgaggtcaggagatcgagaccatcctggctaacacggtgaaacccagtctctactaaaaatagaataaattaaccgggcgtggtggcgggtgcctatactcccagctactccggaggctgaggcagaagaatggcgtgaacccgggaggcggaggttgcagtgagcggagatcgcgcccctgcactccagcctgggcgacagagcgagactgtcttaaaaaaacaaacaacaacaacaaaaaaaccccaaaaacttctttactcagaagtaccctcctttgcattggagatacatgtaaagagttgcttagcagttgaataactcaaaattgcattttggaagcttgctaagtgacaagaccttcttgtatccttttgtgaacccccaaaatatgagacaggcctcagttaatttagaaagttaattttgccaaagttgaggacacgcgtccatgacatagcctcaggaggtcttgtagacatgtgcccaaggtgatcagagcacggtttggttttatacattctagggagaaatgagacatcaatcaatatatgtaagatgaacattggttcattctggaaagactggacaactcaaagcaaaggcaggaagactctgagtggggagggagcttccagggcatagatagataagagacaaatggttgcattcctttgagtttctgattagcctctccaaaggaggcagtcagatatgcgtttatctcagtgagcagaggggtgactttttaaagaatgggaggcaggttggccctaagcagttcccagcttgacttttctctttagcttagtgaggtggaggccccaagatttattttcctttcacactttaggccttatgtctgtttttagttttatatagtagaattccttaaaacaatcttcaactaattcttagggtcttcttaaattcaaaagacaaaccgtatgagccctcctccctgtaacttattccaaatcttaatccatgttttctgtttagttatgcaaaataaatcgaaagaattctgttctccatctctagcctccaaaacctgaaccaaaacaaaagttgtcaaaacagatttttcagtaagaatacactacacatcaagtggctaatgtaaattacaaaacaggatgttaatggcagactgtaatatctctattgtacagataaaaataatcagggtcagagagattaaatattctgcccaaggtcacacagctaaaagcagtggaacagctataagaacccatttcttctggtattaactggtatttacactctttttttttttttttttttaataaataagtggattctggctatgttgcccaggcctgtctggaactcctgggcccaagcaatccttccacctcagcctccaaagtgttgggattacaggtgtgagccagtgcacccagccattaacactcttaaccactacactatactaccttcttacatttatttatttatttatttgagacagggtctcactttgtcacccaagctgaagtacagtggcatcatctcggcttactcaacctcctgggatcaagtgatcctcccacctcagcccccaaagtagctgggactacaggtacaccaccacattggctaagtagtgttattttttgtagagacagggttttgctatgttgccaaggctggtctcaaactcctgagctcaaccaatctgtctgccttggcctcccaaagtactgggattatgggcctgagccactgttcccggccaaattcttttcttttctcttttctttttctttctttcctttcttttctttctttctctttcttttctttccttcatccttccctccccttcctttcctttcccttttcccctcccttcccccttctgttcccttttcccttcccttttccctcctctcccttcccctcccctccctttttcctcctgcctcagcctcccaagtagctgggaccacagacatattccaccatgcccagctattttatgtatttttggtagagttggcgttttgtagagaccagcatgttgcccaagctggtatccagctgctgagctcaggcgatctactcgccttggcctcccaaagtgttggtagtagaggtgtgagccaccgtgcccagaccccaaatttatttttattttattttatttttctaggtcaggcatggtggctcacacctgtaatcccagcatgttgggaggccaagatgggagactcacttgagcccagaagttccagaccagccttggcaatatagtgagatgccatttctattttaaaaaatattttaaaaataaaatatttttctattcacctttcatcaatacaaacccagaagagaatctttcttatttttaaaaatgaggaaattgagccctacaagaaaaattgctatagtttattgatcacttgctaagccatgtacttcatttaatcatcgcttttgaacacagtgttgtataaagttgcccaggctcaaaagcatgtactcataacatactacactaggtagtatgttttcctcatctctggttattttattttatttttttttgctctgtcacctaggctggagtgcagtggggcgatcttggctcactgtagcctctgcctcctgggttccagcgattctcctgtatcagcctccggggtagctggaattacaggcacatgccactgcgcccggctaatttttgtatttttagcagagagggggtttcaccatgttggccaggctggtctcgaactcctgacctaggtggtccacccacctcggcctcccaaaatgctgggattacaggtgtgagccaccgcgcccagcctctgactatttttcttagtgagatctttttagtcacaaatatgtatatggaatttacattccagtcccttgggtttaataatgtacagacagcagaccccctgtatcttcaggtttcaaacccacagattcagccaatagcagatgtggaacctgcagatgcagaatggcaactgtaagggccttgagcatctgcagattttggtatcacggggatcctggaaccaatctccccaaatacccaggtacaactataattatttttgctgattgttatgtctcattagaatgcaagcttattaaggaaaccatatctcttccttttttctttccttctttttttttttttttttttttgagacagtctcgctgtgtcacccaggctggagtgcagtggcgctatctcagctcactgcaatctctgcctcctgggttcaggtgattctcctgcctcagctgcccaagtagctgggactacaggtgcacaccaccacacccggctaatttttttttttttttgtatttttagtagagatggggtttcactgtgttgaccaggctggtcttgaatgcctgacctcaagtgatctgcccacctcggcctcccagagtgctgggattacaggtgtgagccaccatgcatggcctgcctttgaattttttaaaacatttgagcagatatattctataaatagcggtactatttaatagcaataagtggttactgagcacttacaatatgccattgtacttaatgtgcattatcccatttaatcctctcaacagtttaatccatgccactcaccttgttctctgcgagactgattcaattctgttgtagtccccttattcattacatgacagtataatttttgccatttcctcctaacctttgtaaactctactttgatctcatctgactgtaattcaccactgctcttgtttaaagttcacattctctaaacacttatttatctgcacagtacaagaatatctgtgcttctacagagagtcttgtccacccactttcccttccagaaggggattggtatgtgaattctgagtgtttggatcgtttggcccaccctattacctctcaacaactcaagctctctgccatgaagttaaaaaccttcccttactctcagtgccctttattgtctcctctttttttgttttttgagccagagtctcgctctgctgcccaggctggaatgcagtggcacgatcttggctcactgcaccctccgtctcctgggttcaagcgattctcctgcctcagcctcccgagtagctgggactacaggcgtgcgccactacgcctggctagtttttgtagttttagtagagacggtgtttcaccatgttggccaggctggtctccaactcctgacctcaggtaatccacccgcctcggtctcccagagggctgagattacaggcgtgagccaccacgtccggcctaccatttagcatttataaaagtttcccagttaggccaggtgcagtggctcatgcctgtaatcccagcactttgggaggccaaggtgggagtttgagaccaacctggccaacatggtgaaaccccgtctctactaaaaatacaaaaattagccaggcatggtggcgggcgcctgtaatcccaactactcagcaggctgaggcaggagaattgcttgaacccgggaggcggaggttgcagtgagccaagatcgtgccactgcactctagcctgggcaacacagcgagactccgtctcaaaaaaaaaaaggggtttcaaagttaaagaaattaggtagcttaaagctaaatatccaagactatttaccaggtaccactgcaacattaataaggttatttcacaaaatctccctccccttgcccaaatctccatccttcctgactgtacaaatattttcatgtttattttttatttatttattttttttaagacagagtcttgttctgtcaccaggctggagtgcagtggcatgactttggctcactacaacctctccctcccaggttcaagtgattcttgtgcctcagcctcaagagtagctgggactacaggcatgagccaccacgcctggctaatttttgtatttttagtagagacagggtttcacatgttggctaggctggtcttgaactcctggcctcaagtgatctgtgctgggattataagcatgagccaccatggccggccagaaattttttttttttttttttgagatgaagtttcgctcttattgcccaggctggagtgcaatggcgcgatctcagctcaccaccacccccgcctcccagtttcaagtgattctcctgcctcagcctcccaggtagctgggattacaggcatgcaccaccctacccagctaattttgtatttttagtagagatgggttttctccatgttggtcaggctggtctcaaactcctgacctcaggtgatccacccatctcagcctcccaaagtgctgggattacaggcgtgagccactgcacccagcccagaattttttttttttttttgagatggagtctcactctgttgcccaggctagaatgcagtggcacgacctcagcttactgcagcctctgcctcccaagttcaagcagttctctgcctcagcctcccaagtagctgagattacaggcgcctgccaccacgcctggctaatttttgtatttttagtagagacagggtttcaccttattggccaggctgttcttgaactcctgaccttgtgatccacccaccttggcctcccaaagtgctgggatacaggcatgagccaccacacccagcagaaattttttttaatgtatcacagttacttaaatatcttctaagctacaaaacatagaaacgagagaattaatctacaaattttttttctctaaaaattagatttactgattcatgtaatactgtcttcatggtaaatggtggttgatagtgttaacaaaataatcacctaatgttaaattcatgtatctatatggttctcaaattttaacagaattctcaaacttaagcctgaggtttgttaaaactggaatgctaaaagctgggcatggtggcccacacttgtagtcccagctacttaggaggctcattggagcctaggagttagagtctagcctggacaacaaagcaagacctcctctcatgtctttctttttctttcttttttttttttttttggggggggtgggtgggacagagtctcactctgttacccaggctggaatgcagtggtatgatcgtggctcactgcaacctctagctcttgggctcaagtgatcctcttcccttagtctcctgagcagcttggactataagcatgtgcccccatgcctggctaatttttaaaatttttttagagatggggtcttgctttgttgcctaggctggtcttgaacccctggcttcaagcaatcctcccacctcagcctcccgaagtattgtgattaaaggtgtgagccaccatgccagccaagactccatcttttaaaacaaaataactaactaaattgctgggactctcacttctagccaagaccaagtaacaaaaaccagatttacccactcacctaaaataaaaagaaacaaactaggcagcaaatatgaaataatggtttttgaagacactggataccaggcatcaaaggacaatgattcctaaaagagaaggcacaaatgcagggagctgggagattgtcccagtttattgccttgggaatgtgtccaagttgcagcacagaaacggaacagagtaagcctggtggagtctttgagccgagagtctaggaaaaccaaaccttaggacagaattccagagaggagagagcagcacagaaagagagagagctgcagaagtttccttagaatattcagcagagtaattattagcacatgaatctgagcaaactacccaaaaccaaggggaaaatcaacagataaggttagaggaaacattgtccagggttggttgggaacaatgcctggttctatcaatcagccagattgaaaaaaactcataacctgtgggacagtgggtagagtactcaaaaaggtcttgcctcactgatgaagaataattaattctaaattgagtactactctggacctacctaaaaaattataaaaaacctgaaaagatcaaattatttcccagtcatttaactacatcctagaacaaaccgcacaaggatttaaagtaaaacgaaaatacacaatatcaaacaaggtaaaattctggcatctaatacaaaattattgggcatgcaaagaggaaggaatacatgaccatcatgagagtaattgatcaattgaaaccaacacagaactgacagagatgttattttaaataagtaaagacatgtaagatatttttaaaagacttgagcatctagaaataaaaacaatgtctgagatgaaaagtacactagatggaattaacagtagattaaactacacagaagaaaagattaataaacttaaactcatagaaataggaactattcaaaatgaaacagaaaagagtcaaaaaggaaaaatgaagagcattagtgagctgtgaaatagcctcaagtagcctaatacatgggtaactgaagtccctaaaagaagggaagagggacagaaaaaaatatgttaagaaataatgaccaatgacccacattttcccaaatttggttaaaccacacgtatagatgctttactaagtccaagcacaagaaacatggagaaaattatatcaaagtgtattgctatcaaataagttgaaaccagtgataaagaggaaatcttaaaagcagtcagagaaaaagagacttaggaaccatataggaacaaagataagggtgacatcgtatttctcactggaaacattgcagacaagaagtggagtaacatcttaaaatagggaaagtaaaaaaggtcagcctagaaatctatgtccagcaaaaatatcttataaaaagaaggaaaaataaagatgctttcagacatgcaaaagttgaaagaattccttgacagtaaacctatactaccagaaatgttaaaggcagtttttcaggcaaaagaaaaatgacaccatatggatctatccaacgaaatagcatgggaaaagattaagtataatagtgtatatgtaaactttttaatttaaaactttttttaaaaacagataactgtttaaacaaaaataacatactgtgagatttataacataaaagcaaaatttatgaactataatataaagactggaagaaaaaaatggaaacattattgtaaggttcctattctatacacaaagtggtataatatcactgaaggtagactagtaaattaaagatgtatataatagcggggcagttccaagatggccgaataggaacagctccagtctacagctcccagtgtgagtgacacagaagacaggtgagttctgcatttccaactgagctttgaagagagtagtggttctcccagcatggagtctgagatctgagaacggacagactgcctactcaagtgggtccctgacccccgagtagcctaactcggaggcatcccccagtaggggcagactgacaccccacacagccgggtacccctctgagacgaagcttccagaggaacaatcaggcagcaacatttgctgtttagcaatattcatggttctgcagcctccgctgctgatacctaggcaaacagggtctggagtggacctccagcaaactccaacagacctgcagctgagggtcctgactgttagaaggaaaactaacaaacaggacatttgcaccaaaaccccacctgtacatcaccatcatcaaagaccaaaggtagataaaaccacaaagatggggaaaaacacagcagaaaagctgaaaattctaaaaatcagagcgcgtctccccctccgaaggaacgcagctcctcaccagcaacagaacaaagctggatggagaatgactttgatgagttgggagaagaaggcttcagacgatcaaacttctccaagctaaaggaggaagttcaaacccacgcaaagaagtaaaaaaccttgaaaaaagattagatgaatggctaactagaataaccagtgtagagaagtccttaagtgacctgatggagctgaaaaccacagcacaagaactatgtgacgaatgcacaagcttcagtagccgattcgatcaactggaagaaagggtatcagtaatggaagatcacatgaatgaaatgaatcaagaagtttagagaaaagagtaaaaataaatgacaaagcctcgaagaaatatgggactatgtgaaaagaccaaatctacgtctgattggtgtacctgaaagtgatggggagaatggaatggagccacgttggaaaacactctaaaggatattatccaggagaacttccccaacctagcaaggcaggccaacattcaaattcaggaaatacacagaacgccacaaagatactcctcaagaagagcaactccaagacacataattgtcagattcaccaaagttgaaatgaaggaaaaaatattaagggcagccagagagaaaggtcgggttactcacaaagggaagcccatcagactaacagctgagctctcggcagaaactctacaagccagaagagagtgggggccaatattcaacattctcaaagaaaagaattttcaacccagaatttcatatgcagccaaactaagcttcataagcaaaggagaaataaaatcctttacagacaagcaaatgctgagagattttgtcaccaccaggcctgccctacaagagctcctgaaggaagcactaaacatggaaaggaacaagcagtaccagccactgcaaaaacatgccaaattgtaaagaccattgatgctaggaagaaactgcatcaagtaatgagcaaaataaccagctaacatcataatgacaggatcaaattcacacataacaatattaaccttaaatgtaaatgggctaaatgctccaattaaaagacacagactggcaagttggataaagagtcaagacccatcagtgtgctgtattcaggagacccatctcatgtgcagagacacacataggctcaaaataaaggcatggaggaagatctgccaagcaaatggaaaacaaaaaaaggcaggggttgcaatcctagtctctgataaaacagactt

SEQ ID NO: 860 - DNA, 1484 bp, Homo sapiens
ggcaaagttcagcatcatcctctctgctgaaataaccaacatggtgctcattaattggtcatgtgagcactaaggataaccaccctcccctcctcaatcaggatcacaaatgctagctttcatatggatttcaagctgggtgaaatgactttttttgcttgtaaagaagaaatgatgatggaggtctcatcaggaagtgatgcagaagactgggacagacgggggtttcaccatgttggccaggatggtctcaaactcctaacctcgcgatccacccacctcggcctcccaaagtgctaggattacaggcgtgaggcactgcacccagcccatcataagtattttcatgtatcatcatgtattttagaaaatggtattattgactatatatcagttcattgtgtgcacacattttatttaattaatttgctcttttcagttatttagttttctttttttgttattataaatttcatagtaatatatgtccttatacataaatctgagtatgaatctaggattatttacttaaaatgaatttccagacacaaattgtggggttaaagtgggaggagcatttttaaagcttttgatatataccgctaaattgtcttataggaatgtataaattatgaaacaaccagctgtccatgtgagaccatgcatttccttatccaaatgaagttaaagaaattatttgtcagcttttttggtggtatgtggtaactccttttcctgatttgaatgtttttctagtactagtgactttttacaggtttttcttatgtttgttggttgagtttttttttttaatgtctatgcctatcttagtatctatgcctattttaattttttaatgtctatgtactttcttttggagcatgttgtatgatattttataaataaaaggtgttaactctgtcattatagtgtaaatatatttcccaatatgtttttaaattttcatttatgatatatagaaattttaacttttatatattaaaaatatctatatttaaatgactttgtccagatgtagtgactcatgcctgtaatcacagaattttgagaggctatgtcaagaggattgcttgaggccaggagttcctggccagcctggacgacacagtgagacccctatctctaaaaaagttttttttcaaacaatcctgccacctcagcttcctaaagtgctgggattacaggcatgaaccattgagcccaggttctttgtaatatcttcctccacgtttttacgtatcaatcctgcattcaaacatttactcattctgaaacaaattttagtatatgttataaggtattgatccaaatttttacgtttataaatagttaacatctccaaaccatttattgatattaatttcaccttcatcatattgtaaattatagttttgattttcctttttgacaatgaattatctaagaggatactttagaattttcaaacttaataaaaaactttt

SEQ ID NO: 861 - DNA, 2023 bp, Homo sapiens
gcgcacgcgggaactgggatctcaaccccagggctaggtgcctcctcccgctgctttccgccagctgcggggtgtgagattaatccccgccgattagcgccaggtgtactaagcgctggatggttccctgaccagatgaaacatcagccgatgttctaatgccggtcccctgggcgctgtccccgagagggaaaacctgttttctgaccccggctctagtcggcctctggaggtctgcagctgggttattttacctttgaaacggacgacacctgccccgtgcaccccagcggctcctccacacggagagatggtgtcagtcaaaggccgtctagatgacgagtttatgaaattgttcctggcccgtgccgggcacgaccttgcagagagcccagaagatgaaaccccagccctgccaggagctcacctgctaattaggaggacaacgaatcacctcacctccctagactttgcttctcctttattcagtgagggattggactagctggtccttgaggacttttcagaaagtctggttctgggagatgaccaatgggatcatcttatgctatgagctttcctggaatgacaggtaattggtgcgccttcccagcagggtcagggagagttgctgggacttgaaggaaaggcttttggggagaggagccagtgttacaaactatcgaaaagcttggaggtgggaaatttacaaaaggtgattccagggtcagcttttttgtcacctgcttccgacttcggcagtttggagagggcgagtaagtaatacccttcagggtcttgggatgtggcccagcaaaatccttagagggactttgaagtcttagttttaagtttagaattaatgggcagagtacttaaatagccatttctccaaagatgtatacaaatggcccacaggcccataaaaatgttgcattccaccctataacatgtttttgcataaaaaagttttaaaataactgttgtctggtaaattgacacctctggaatagaatgtatgctaggttttttaccctactgcttcaaaccccatcctacacacacactcctagggtgtgcatcatccagtttaagaagcacccttggagaaacaaagttgatagtgtgtccagaattgatgggttcttggtctcactaacgcaagactgaagctgcagaccctcgcggtgttagtttttaaaggcggtgtgtctggagtttgttccctcagatgttccgatgggtttggagttttttccttctggtgggtttgtggtcttgctggctcaggagtgaagctgcagaccttcgcctgagtgttacagcttttaagacggcatgtactggagttgctagttcaccccggtgggttcgtgtatctcactagcttcaggagtgaagctgcagacatttgcagtgagtgttacagctcataaaggcagtgcagacctaaaaaacaaaaagaacaaagcttccatactgtggtaagaaaatcctagtgagttactgctgctgtcttagggcagcctgtgtttattctcttctctggccccacccacatcctgctgattggtccattttagagagagctgattggtctgttttacagagagctgattgagccgttttgacagggtgctgattggtgcgtttataatccctgagctagacacaaaagttctccaggtcaccactagattagcgagatacacagtgtcgattggtgtatttacaaaccgtgagctagacacagagtgctgattggtgcatttacaaactttgagctagatacagagtgccgattggtgcattcacaatcccttagctagacaaaggttctccaagtccccaccagattaactagatacacagtgccgattggttcattcacaaaccctgagctagacacagggtgctgattggtgtgtttgcaaaccttgagctagatacagagtgcccattggtgtatttacaatcccttagctagacataaaggttctccaagtccccactagacttagga

SEQ ID NO: 862 - DNA, 22622 bp, Homo sapiens
gttccttccggcgtctccaaccgccgcctgctcccgccgtccacccgcgcgggccgcctgggacggggagggccgggctgcgggcttttctcccttccagagtcctgcgcccgcccaaagcccccccgcagaggctgggcagcggctccgggaagtggacgccgtttgcccagacggtgggctcgactgaagcggcgcggtcccgggtggggccgcccgggaagaaagtctcccagttaagctgccgtgcaattaagatggttgggtttggattgttgtacttttttttttgttcgttgcatttttaggaacaaaaaaaaaagcccaacccttcacaccacttcatccgcatctcaagaccagaagccgaccccagcggcttggggaaatggagccccgcaccccacaagggggagggtgggacgggcacctccgcactgcgcggcctgcggagtcaccgattcgcgttgggagcgcgccaggagcgccagggctctagccgggggctccgggcaaggcgcaaccagaaaagggttcagtatcccccatcacccccacccccaaccgtaccctctttctttgcgggctttaggcaggacaccagagacccaattctatttaaaattctcttttaagaaaaggaacgcctgtttttgcctttgggggaaaggatgaactttcaaattggctttaaattatccaccactaacagttactcagtcgataacctgactattctgacgtccacctcccgtttgaggaccttgcccaatagcaaacgtactaagcacttaaccagtgaacggtgtgaaggatgcaaacatggatgatgaaggaatggctcctccagaatttacgatcttgggagaagtgaggcgagtatagaatctcagaacacgctgtaggattgagttcgatcccagttgaggaagtttgggtttggggaggaaataggttattttggagaaacggtattcaaaacctaccataaatagcagtacagcccgttgactaataatgcttagcccaacccccgtaaaaagcccctggccacatccgtctcctgagattcccacttctctgtgtgcatctcccttcctgctataagaaacctaactttgccttcgtagaacacttcttttaatttctgtcattcagtctcataacactgtgtaaaagaaattatgatcttcatcctatatagatgagaaaacaggtgaagtgacttttccaaggtacaaaagcaagaggcagagctgaggctaaaggcagcttccagatatgggctctttctacagcaccataactgtcagtgacaaaactgcaccccagtaccttactaaatttagtgtttttaggccaggcacggtggctcacgcctgtaatcccagcactttgggaggtcgaggcgggcagatcacctgaggtcaggagttccagaccggactgaccaacatggtgaaacctggtctctactaaaaatacaaaaattagccggtcatggtgccgtatgcctgtagtcccagctacttgagaggctgaggcaggagaatagcttgaacccgggagatggaggttgcagtgagccgagatcctaccactgcactccagcctgggcaacagagcaagactccgtctcaataactaaattaattaattaatttagtgtttctaaaaaaacaaagtgatctgtagaaacatctcatttatttgttgtcattgtgtgttgattgattttgagacagggtctatctctgtcccccaggctggagtgcagtagcatgatcatggctcactacagcctcaagcccctgggcccaagttatcctcctcccttagcctcccaagtagctgggaccacagacatgcgccaccacgcctggctaattttattttttgtaaagatagagtctcactatgttgcccaggctggtgtcaaactcctgggctcaagtgttcctcaggcctcagcctcccaaagtgctgggattacaggcgtgagccaccacacccagccatatggaaacatttcagatatcctaatattaaaatgatatttcacaagactggacagttattaactcatgtgaaaggaaaatcttggggccccaaaatcactaagctaaaggaaaaagtcaagcttcggagaactgcttagggcaaacctgcctcccattctattcaaagtcatccctctgctcactgagataaatgaatatctgattgcctcctttggaaagggtaaccagaaactcaaaagaatgcagtgatttgcctcttatctccctaaaacctggaagcccgccccctgttttgagttgtcccacctttgcttcaagtcgtcccaccttttctggactgaaccagtgttcatcttacacacgctgattgatgtctcgtgtcttcctaaaatgtacaaaaccaaactgctctgaccacctcgggttctgacctcctgaagctgtatcatgggcacgcatcctcaaccgtggcaaaataaactttctaaattaactgggacatggctcagatttttagggttcacacgcaaaacccacaaattatccttaatataattatataatatatatttatgtagttagatctggttggtggtagatactaatacacttttgcccaactaagtgtaaaacacattaaatctgtatagcaatctctagactattacacaaaattaactactaactagaaaacacagtatattaaattctcttaagtgtggaaaaatggagaaggaagaataaccttttctctcctcccgtggtcctaatacacagaacagcgactgggaaactgccactagaaaaagatgactgtccaactaaaacctgcatacacagctacatccttccctggaagagcacagtggaactagatcctagtacagatagcacagggattgtcaacattcttgtcacactgaaatttccttctactgatctccaaagatggtgttttgccatgttgcctaggctagtctcaaactcacagactccaatgatccacccgctttggccaatcaaagtgctggaattacaggtatgagccactgtgccaaaccaagaaatttattttcatattttgagatttgttattgaaaattacagatttttaaaaatgcaataacatataaaagtacatcatatatggttcagtcttactgaaccatttaatataatattttgtcaaagtactcaatttataaataaaatataaaaatcattaattgtgacaaatattttcctaaaatcttccaaaaggaaactatatatgtgtgaatacatataatttgcttgtatatcaatcatatgtataatttatctttctttttttctcagacagagtcttgctctgtcacccaggctggagtgtaatggtgcaatcttggctcactgcaacccccgtctcccaggttcacgcgattctcctgcctcagcctgccaaggtttacaggtgcctgccaccacccctggataattatttgtatttttagtagagatgggatttcgacatgttggccaggctggtcttgaactcctgacctcaggtgatccacccaccttggcctcccaaagtgctgggattacaggcatgagtcactgcgcccagccaatttatcttgttagaatgattgtaactgtattctgtaaaaggccggtgttaatagattgcttagctacattttagagtatgcttcactagagccttaaaaatcattacatatatatcctctgaaatgtattattgctttgatattttaacaatgattaattacattcaattatgacaattaaatgtttttctaaattcccatatatgtagaattttattttttacaaacagtaactttatgagggccttaagaaatgattaatttaggctgagtgtgatggctcacgctggtaatcccagcactttgggaggctgaggtgggcggatcacctgaggtcaggagttcgagaccagcctgacaacatggagaaaccccgtccctactaaaaatacaaaaaagttagctgggtgtggtggcgcatgcctgtaatcccagctactcgggaggctgaggcaggagaatcacttgaacctgggaggcggaggttgtggtgagccgagatcactccactgcactccagcctgggcaacaagagcgaaactccatctcaaaaataaaaataaaaataaaaaataaatgattaattcagctaaagactaatagatactgtatatttgcaattgttggagagctcgatttgtataaattgtttattttgaatctttctgagctcactcaccattatgtgctaatttttaccctgagaagtgtcaattatgataacattttggattagaaaactactttcatcctgttttatgggagatttttagagcatttttagagcattctataaataaggatacatcatggataggggttctgcagttttcagtagctggtagatacctgtaccttaagcacactctttgtcttaaataaagacaatagaccaatgcatagaatttttgttctgaggatctagactttatcagatacttcctatacagcattgcataagacatagatgcttcattgtttttaacatgagcccagttgagtctctctaatattaaagcattgggtaataaatgccttgttaaaatgtgtttatcttataatggtcttgtttgtaacactatctggattgttgctagaatgcccccagatctccagaagtgtggaatttgatctaaagcaacccacacccctcccagtcaggcaaaagacacagataattcagaagatggttgaaactaattatacaatatcagtgcattttaagcattttgtgaatgtcattggcctccatgttgctaactccaacagatattttttcagttctcattttccttgatcttttggtagccttcaactctgagtaccactgcctcctttttaaaaggccctcttttcctctgccattagtaacactaaactcactcctggcttttcttcttcagactcaggaatacttgctgggtcatccttttctacccagcatttaaattctggaattcaaacgctcagttttaggaccctcctaggagttcagtgatcatttattgactcttacaatccctgtcaaaaacacaaactgtttgcctattgttactctatttttaaatgatgaaaactgaattttaatacttgagaggcatgtcacttcttcctctcccacaatccttactctgtgtaggcatttgggttagcccttgtgttacccgaggctcatactgcttccagcagcagggctcctgcacccttagttccttccctaacgaggccctcaccagccacctcccatccccatcctccaaccatagcacaactgacagtctcaggtgagctttcccagatgtttctggccaattaacagaccctgttaatcatctcataccatctaatactgctcttccatcatgcactctgcagtttgttaaatttatttgtgtaattatttgattaatgtttgtctccccacttgactgtaaaccccataagagctgggattgtgtgtgtgtgtttgtgtgtgtgtgtgttttctcatcattgcattactagcacctaacccagtgatttcatgaatgtcttaaggaagtaagagtctcctatttcacggtattgatgtatttcagacttctaaaaatttgctgttgagaccagctgaaatggtaagtactctgaattttaatttactcaaaataggcacttcaatacattttactttatcaaaacaaagtagctttccatcctttctttacacagcaagtattaccatactcctatagtcaaactcttcctagagtttacacagaagtgctggtagtcttcattttcacagaacaacatagcataactcttaaaatgaggagaatttcctgaagagtcatcagagaattattattattattgttattattttaagacagagtctcgctctgtcaccaggctggagtgcagtggtgagatctcagctcactgcagcctccacctcccgggttaaagcgattctccagcttcagtctcccaagtagctgggattacaggcacgcaccaccacacttggctaatgtctgatgtgctctcactaaggtaagagtctatttatgcctgggagatagaggaagcctacagtctggaagcccaaagcagtgctcaggcccagtttactggagtatttgtagcaaagtgatgcttaattctcatttgctagtgttctctattcatccgttttccttgggggatcttgggtttggttgtgtgtggctacagcgtagggatgagattctatcatctttgtgttaggcggctgtagtgcctttgttttcgtttttgttttgttttttgtttttgtttttatttttgttttgagacaaagtctccctctgttgcccagactggagtgtagtggtgcaatctcggctcactgcaacctccgcctcccaagggcaagtgattctcctgcttcagcctccgaagtagctgggattataggtgtatcccaccatgcctggctaatttttgcatttttagtagagacagggtttcaccatgttggccagggtggtcttgaactcctgatcccaggtgatctgcccgccttggcctcccaaagtgctgggattacagacctgagccaccatgcctggcctatagtgccttcttttttttttttttaacacagagtctcgctctgtcacccaggctggagtgcagtggcacaatctcagcttactgcaacctccgcctcctgggttcaagcgattctcctgcctcagcctcccaagtagctgggattacaggcatgtgccaccatacctggctaattttttgtatttttagtagagacggggtttcaccatgttagccaatatggtctcaatctcctgacctcgtgatccacccacctcagcctcccaaagtgctgggattacaggcatgagccactgcacctggcctttatggtgtcttcttaaggtgaatagcacctcaccctgatttttaacatgtagcattttgcattgcactatatctactgaagatgttaatcacttctgcatctttccatagctttcaacatgatacttttcaatggctgcataatttcattaatacacctaaatgtaaggtgtatgtaaaggaaaaagacagtgaaatccttgtgtggttattcatacaagtccctatttagggagcaaatgattatgtggggccaggatatcatggctgttaaatgactgcccatgtgacactgggcagggagtgcctctgatactaggcaggctagagatgatgtttttggaaccaggagggaaaagctagaaaaagtggcataaatataggaaaagaataggaatttcaagaattgagtatagtcttaaatgttgaccaaaaaaaagtaaattgagccctgaaaaatgatagaattttccaattaggttactaatgattttaccagcctggccaacatggtgaaaccccatctctactaaaaatacaaaaacattaacgaagtgttggcacacgcctgtaatcccagctactcaggaggcgaggcaaaaaagtcacttgaacctgggaggcagaggtgatagtaagccgagattgcgccactgcactctagaccgggtgacagagcaagactctgtttcaaaaaaaaaaagaaaaaaaaatcaattatgttactaatgattttaggaaaagaaattttatctctgttttggggccagaggtagggaaagggaaagggttaaaattaagtatttactggccagacgaggtagctcacatctgtaatcccagcagtttgggaggctgaggtgggcagatcacaaggtcaggagttcgagaccagcctggccaatatggtgaaacccccgtctctactaaaaatacaaaaattagccaggcatggtgtcacatgcctgtagtcctagctactcgggaggctgaggcaggagaatcacttgaacccgggaggcggaggttgcagtgagccaagatcgtgccaccgcactccagcctgggcaacagagcgagactccacctcaaaaaaataaaaataaaaaaaataagtatttactatctgccagggactatgttggaaatttttcttgcattacctcattttacaagtcacagtggggaaactgagggttggagtagttcattaacctgcccacagtcacatagggcaggttacccaggtcagtcttcattccactgcagtcagaagtgaatgaagattaaggaagcagagacaaggagtatgaacaattctttctggaagaatgatggggaaagaagagaaaggattgataaagtatagtgacagataatctctgcttttataataaaaataaagctcagctcctctgaggttgacactgaaaaagagtaactgcaggggccagaagcagagagaccaacaaaccctggcccctgccctggagattcatctttctcccgagactctccctctgatgattttggctccatcgaagcctccttgggtcatttcttccttcatatctgaggtacaggcaatgggatgacaaaaggcatttttcaacatctctccacaactaagtcaaagctgaaaagtttaaaggacttttctgaacatgagggcaatgtttcccaaccttttgaggtcatagaaactgctctggacaccagtttaaatatacagaatcttgggggacatggattttgaaggtctgcagtgggagcctgggaaaaggtattttaaagtaataccggttacccttaaatttctgcaagttctagtatcactgtgctggcaagtaacaaagagaaataaacacagtagcataaagcctggcatgtagcctggctcacaaaaaaaaaagacctgcttataaccccattctggagtcctcacctgcccctgcaggtttgatgctatcttgacacatgctggctatttttatctcctagaaaacaatctaggccccacagatggaggccctttgccaaattataaggtggtgggggaggaagggaagaggcttcttcactcaataatttttccttttctttttctttttcttttttcctttttttttttttttatggagtttcactgttgtcgcccaggctggagtgcaatggcccaatctcagctcactgcaacctccacctcccgggttcaagcgattctcctgcctcagcctcccgagtagccaggattataggcacccaccaccacaccctaattttttgtatttttagtagagatggggtttcaccatgttgaccaggctggtcttgaactcctgacctcaagtgattcactcgccttggcttcccaaagcattgggattataggcatgggccaccgtgcctggccactcaatatttttcaaagaccaggttgttagtctttttattttttgagacagtgtcttgctcagttgcccaggctggagtgcagtggtgcagtcatagctcactgcagcttctaactcctgggctcaagtgatccaccttcctcagcctcctgagtagctgggactacaggtgcatgtcaccaggaccagctaatttttttttaacttttttttttttttttttgtagagacaaggtctcactaggtggtccaggctggtctcaaacttctggcctcaagcaatcctcccaccttggcctcccaaagtgctgggattataggcatgagccactgtgcccagcagttgttagttctttaccagcacatgatgtaagtcttcccgacacagacaaggtctagcttggcccgccagactgcttctgccttgttgtccctccagcagtgagtggcagaatgatggcagccagctttctcccacaggctgctcagtctgactacgcattagtattagggaaggtgaccatacatgttcaggtttgcctgggaagagtcctgaccacacctttgagcccagactctcctccacttagtctttcattttcatttattaattcccagtttggatgataaattacatagtcaccccgtctgtgaacaaaagagctagaacaaaaatacaactccacaaaagcaagaagtggactgccaacaacttaataacttccatggatcaaggaaatcatgctgtgacaccacacacatcatttcaactcatcctcacagcaaccccacaagggaattttggagacatgaattttgcagataaggaaagtaacagggtgaagtgagttggccagggtcatccaactatgaggaacagaggtagggtcaaagatccatctgcatgagcccagctcctgctctagatgggcctacctgcctcctcagggcatgtggtcacctcacccaccaattactgactgcgttaagaaatagaattttaccaagaaagttgcttgatttcaacatgaaagaaatactctcaatattcatatttttcatcttaaatttgaaagtagaaatctgctttctgcagctgtctaattcagctcttgtttctgtaacctagtttgaaagaagcaactaaagaaagaaactttgaaagaagcttccaaaagaagcaaccaagtctacaaaggcacagtttgactcaaatggatccaactgattagcaaatggaaaataacatggaggaatatattttgcatgacaagcatagcagctccaagtcatccctaatgaagccaaaaatttaagtgcaacccagagaatggatggttcagaatcttttttttttttgagatggagtctcgctctgtcacctaggctggagtgcggtggcatgatctcggctcactgcaagctccgcctcctgggttcacgccattctcctgcctcagccttccgggtagctgggactacaggtgcctgccaccacgcccggctaattttttgtatttttagtagagacggggtttcaccgtgttagctaggatggtctcaatctcctgacctcgtgatctgcccgcctcagcctcccaaagtgctggaattacaggcgtgagccaccgcgcccggcccagaatcttttttaaattttttattattattattttttctgagatggagtccggctctgtggccaggctggagtgcagtggcacaatctcagctcactgcaacctctgactcccaggtacaagtgattctcctgcctcagcctcctgagtagctgggataacaggcacgtgccaccacgcccagctaatttttgtatttttagtagagacggggtttcaccatgttggccaggatggtctcgatctgcctaccttggcctcccaatgtactgggattacaggcgtgagccaccgtacccggcccagaatctttgccttttgtttgcatagtttaatcttctaaaccagttgctttcccagaaaaggtgacttaaagtcatagcctttgtgttcatcaccatactctccatagttttacaaattattcagtttatttttaaaaggggtaatttttaaaatttttatttttaattccgaagcattccttttaatacattctcttgagggaaaaaaaaaatcacacatagtgattgtgtgtggtagtgattatgtgtggcctaagtggcaattgatcaataccccaatctcaagcctgtacattgttactggttgactggttggttgcctggtgggctttttgtccttccagatgtttttctaccttctgccttttccaataaagcttccattataggcgtattttccttcttccctgcataccccacagaaggaaagctgctaaaatctcagagccggaaagttccaagggggctgcagcagcccctctctcctagtttttgttcacccttactaagagcaaggcagctcaagtcagattgctgcatgtgcattttgactccatcattgagcaagttcatttattcactattcattcagcaacatttgagcacttctctcttcctccatggccaccattctagcccatgccaccatgatttattgtttctgtctttgatgctgagcctgtctccctacagccacatggtccttctacacaatcatatcactgctctgcttacatcccttccccagcttcccacccacttagtccaagtccaagtcccttggttgggagccaacagattcctacaggtctgccatctccccaacccatggccaagccatctctgacttctgcctgtgcgctctactctagccacatcggcctccttgctattcctcaaacatgccaaactcgcctcttccttagcaacttggcatttttttttccctctgcctagaatgttcttcctccaaagtctacctggctcactccttcctctccttcagttgttctgctcagatgtcaccttcacgggaaagtcttcctggccatcctattacaaatggtggcctctcactgcctcacagcactccctggtctcctttcctgcttcatttttctccatgccacttatcgccacctgacatactttgtatttctttgattactgtctcctcccactagaatgtgagctctgtacagaagcaatatgctagcagctataagagtgtctggcacatggcaggccctcagtaaatattagttgaatgaatgaatgaagagtttgcatgcagcaatggggagccagatcaggtacggccttgtaagtcctggaaaagactttgggttttattttaaatatgaagagaagccattggagagcacatcatctgatatacagtttagaaagatcactctgggctaggagtggtggctcatgcctgtaatttcaacgctatgggagactgaggcaggaggatcactataggccagtagttcaaggccagcctagcagccatgcacggtggctcacacctgtaatcccagcactttgggaggccaaggtgggcagatcacctgaggtcagaagttcgagaccagcctgggcaacatggtgaaaccccaactctactaaaaatacaaaaattagccaggcatagtggtgggcgctggtagtcccagctactcaggaggctgaagcaggaaaatcacttgaacccgggaggcagaggttgcagtgagccaagatcacaccactgcactccagcctgggcaaaagagcaagactccatctcagaaaacaaaacaaaacaaaacaaaaaaccagcctaggaaacatagcgggactgcatctctacaaaaaattaaaaattagccaggtgtggtggtatgcacctgtagcctaagctgcttgaaaggctaaagtgagaggaccacttgagcccaggagattgaagctgcaatgagctatgaccacaccactgcactgcagcctgggcaatagacttagaccctgtctcaaaaaacaaacaaacaacaacaactaaaaaaacccaccctgcccattgtgtggaaggaagatggtactaagggtaagagtggccccgggggacagtttggaggctaatgcgacatctaagcaagaaagataatgaggacttgagctagggtaggaaaaaaggtcatattttaaaaatatattttggagttatagctgacagaacttgttaataaattggaggaggggccaaagaggaaaagagaaatggaggataacttccaggcttggggcctcaatactgaatctccctgagcctgtttactgttctgtaaaatgagggtaactgggcccccccaccatgggatctctgtgaggaaggaggtagaggatatagactgcccatactgacaggcacatggtaaaccctcagtgcacagtagctcttatcattgccccagtgatgactgtatttcccctgcttcatccataaataggattacagaaataaccaccccatagagactggggaaaaaaacttcttgtagagtgtaccctcccctcctaagggatagacttgtactttaacagaatacttaacagtagtgttgaaacatgttatttgcacacagataaataaaaggattcctcatatttcaaaagaagtgtaacactgttttaagtagtgtttgtccattcaatacttaatagcaggagtaactaaaagctgaaattacaaacccctgctgattaaaaataaatcaaaacataagatataaagcacatgtgaaataataatgatttttttttttttttttgagacggagtctcgctcttgtcaccaggcaggagtgcagtagcacgatcttggctcactgcaacctccacctcccaggttcaagcgattctcctgactcagcctcccgagtagctgggactacaggcaccgtggcaccatgcccaactaatttttgtatttttagtggagacagggtttcaccatgttggacaggatggtctcgatttcttgacctcatgatccacccacctcagcctcccaaagtgccaggattacaggcatgagcccccgcgcctggccataataacgattttttttttttagatggagtttcgcacttgttgcccaggctggagtgcaatggcataatctcagctcaccacaacctctgcatcctgggttcaagtgattctcctgcctcagcctcctgagtaactgggattacaggcatgcaccaccattcctggcttttttttttttttttttttttttttttttttgtatttttagtagagacagggtttctccatgttggtcagggtggtcttgaactcctgaccttaggtgatccgcccaccttggcctcccaaagtgctgggattgcaggggtaagccaccgcgccccgccgcaacaatgacttttttaaaaaacaggcatttactgcattttcgtacactagaagctaaaataccatgctgtccagttcaaaacaggacacctggcaaccctgttcctaacagctttctgcaaagccaacacccagtgctttctggctgcattggcctgtcctcatttccccctggaaaacttgttttaaacagtacagataacattctgcctctattacaattagcagcttctctcaccaggttatctagtgtggcaagtgctagtgcggagtcacttagtatcttctttcaaaacctcccagtggctgccttcaggtagcatgtgaaaagctgctcatggggaattcagcagctgcttcaggccctccagggcatttcttgctggcatcttctgcctcaccagatcgccctgattattagtgatctgggccccctacctaatggaaaaccagccactcttcttcccagccccaatggatattgatgaggggtccttaaatctgggatcctttcccctccttgcccaataattgaactcctaaaatccttttactacctgggaatctgcaaagacaaccttgaatttgaactggagctagaaggacttcctccgaacgaatttgcccatagatgactctctggtacatggtctctgttgttcaactttctctattctgaagtctagaagacacccttgcttctgaaagtggggcctaagaacctgcagcctcaccagggagcttggtagaaatccagaatctgaggcaggattctagacttattggatcagattctgcatttcaacaagattccccagtgacccccaggcatcttcaaatttgagaggccaggaaagtgctcaggccctgcccttcccttcccgttggctggggagaattcctgtaatttgccctgtttacgggtccttaatctccaacttcactgtcctcgctttccaaagaatcctgagtggcttccttccaacaccttatctgtcttcccccacgcccctgaagccagggcctcttttcttcaaggccaccccccaactcatctcaggctgaggctcctctcttgaggccatatcccatggtagcatttctttgagggctgcttttctgccgtttttctccccaggtagggcctctaaaaccgatggaagtgaagtgctacacctcagagctgctttagcccttagagctggccagggtctgagtgggcctctcacagggccacaggactgccctttcccccagcatgcctagaagctgagaccactcacaccacatgaacatgctatccttgttcctctttcctgccagcctcaacacaaccagaatacagcccaataatggctgcctacaaatgggaggcacccagggaagggagggggtgctgattaagaaccagcctggaggaggatcatggtttctctgaaacaagaaggaggtgagggttgatgcggaaggtatattagaaatgcttcaagcacttgatgctttgagggtttggggatttgagtttgggtttgttttttaagcttaacaatgtgaaaaagatgtcaaataacttttctgaactgtggcaatcagagccttgtccagaatcataacttaatggctttttggctctcaatttgatggtcagtttggctaaccaacactttttaattctgtgttatttattactcagttgatcccccccataatatgttaaaagcctacttccaacctgttaaaatgtacccttggagtgctgtccagattcaccattaaaatagtgtctttccagtcttatgtattttattcagcagttactacagtacttttttttttttttttgacaggatctcattctgttgcccaggctggagtccagtggtgtgatcacagctcactgaagctttgacctcctaggctcaagctatcttcctgcctcaggctcctgagtagctgggactataggcacatgccactatacctggctaatttttaattttttgtagaaactgggtctcgctatgttgcccaggctggtctcgaactcctgggttcaagcattcctgacactttggcctcccaaagtgctgggattacaggcatgagatgccatgcctggccatatttttatttttaaatctttctatttaaataaggagagggagagagagagaaagctctaggtgcattttttccaaatggacaccttgccatgttttcaacacacatctaaagcctgaattgagagtataatttttctgtagatacatcaccttgaggaattttataaacttcagtttcctcatctgagaaatgaggtagttggattagatgaactggctcatcaagtgagtataaggagccttccaaatttaagaattattaacatttcccggaagactaaccaggcaatttttcttctttaggtttgactttctgagatgtcatggcttagtattctttaagcaaattctggaatgttcttgtccctttggaataattgtaatgtggatttgttctgtgcaactgatgatattctaatgtgtttgggcaggtttaagtctaaatttccaaagtctcacacctgtggttttaccaaaaaggtactgctcaaggaaaccagtgatgggcaaaggatgcatggtatagctatgatgcaagagcgccctctgcaggccatgcgaagatgagtctctttcttaaagggtagcttttccgctctttgtgtagagtacaacccttcccttcctcctgtagcattctcatcaagaaacatttgtttagtgcttaccctgagctaggcacagtgtgcttagggctgggaacacaaaaataaaagcatcctaggcttaaaggatctcacggtctaatggggtacatcccaatcagatcattataatgcaacctgagaggtgtgtcactggagctgtgcctcatgtccccattagtttgcaatcacaagttgcacacaagagccgaaatcaaactgtacagtacaatgcttttttgttaggagagaaggactggtgactcaccctagcattttctctttgcacagaaacagatgccctgcccagaagcaacacggctaatgggtgccaccgtggagacccaggcaacctgagagtagtcctgacagccagacctccagggtggaaatgggaaggtctacagagaaagtgggagacatgaaactaaacaggaatgatacattgacaataaagaacatgaagagatggttcctggacactacaagaaacctgtggtcccagctactcgaagactgaagtgagaggatcacttgagcccagaaggtcgatgctacagtgagccatgatcatgccactatactccagcctaggtgacagagcgagactccatctcagaaaaaaaaaaaaaaaaaaaaggaaaggaaagaaggaaggaagggaaggaaaggaagggaaggaagggaaggagggaaggagagagggaaggagggagggaaggagggagggactggaagaggagaaggaggagaaggagagggagaaggagaggaaagaagaaagaagaagaaagaggaaggaaggaggaggagggaagaggaggagaaggaagaaggagaagaaatgagacaaaggagaagaaaggagaagaaaaaggaagaagaggaagaggaagaagaggaagcagaagcagcagcagcagcaagaagcagcagcaccagcagaagcagatgcagaagcaacagcagcagaagcagcagctgaagaagcagcagcaagaaaggaggaggaggaggaaggggaggagggggaggggaatggggaggaggaggaggagaaggcagcggcggcagcaagaggggactggtcccagcagggtaggaatctttagatggttattaagaaatggaatgaataaaatggaaattgatgcggttggctgcacatggtggctcacacctgtaatcccagcaatttgggaggctgaggtaggaggatcgtttgagcctaggagttcaagactagcctggccaacatattgagacccccatctgtaaaaaataacaacaataaaaaggaaattgatggagttaaaacaaaggtcttaacgtaacactaccctgaaggttgggtgaaccaaagggagccccttttggtcctccaacattaaagggccccaaaccagtttgctgtatttctcccagtttggagaaatttaaaaagctaaaaggcagcagttacaatgaaaaatctgatctgaatttgcctggggcaatagtcgagcagactaaccaagataaagattaacaagagggccagggtcctttgggtcaccccttggctgggtacccaaagacttttacacaagagagggtaaatggtctaggggtggagaagaaaagttcctgaaactaaaacagaaaaatgtaggggtcgataggactatgaaagttggtatatttgaacacttcatgtgaagtagttgcattttttatctgattttatcatgggaatgaacattgtatctgtgtgggggactgttttccctacctggtactgtaaaagagaaggcatgtaaatcgtcccttcaagcaatattatttggacatgctaagctggaaccagggagactgcccaggcccacacagtgcagagtagaagctacggtgctggtagggacaaattctccacttgataaccctctatggagcatttcctggagcttatggcaaaagcctgtgggcacctcccagcaacaaccactgggactttggactagagaatttccacttgaagggcatttactgactcgcaatgaaacatttactgaagccaccccactgatacctgaaataggcatgctgtctcagatgatgtcagaggaacattctaatggggatggcagtgcccagaagagttccatgacacaatggaaatggtttatagaggatcatgctactcaaggcatgcagagaatttcttttcccctaggactgactctggaactgtgtgagaaactgctggattctacagtgccaaataaacaactttcaactgaccaaacaagagcttcttggtttatggatggcaattccaaggcacaaaatgctaggaagaactgttctgtttctcagtaagagagacagaaactggctatgggaaagatttcctggtgggaaggccctgaacatagctggcaagtgagactgatgctggcagccctgggggactacaaatggaataggaattcttgataggaatagacactgactctagtgcaggctttgcttatccaatggaagatgaaagtgttcagagtgccataaaaaaaaaattaaaaaaaataaacaacagaagatatttcaaggatttggatggctgaccatcatttcttcttcagacaaaggaacacactgtacagcccataatgcccaacaatgggcagagagatatcctccttagagtaatagtttgatagataagtagaatgggcaattaaaatattggttgtctaaaaccagggaagataaaagcatgaaagcctggcttatactcaacgtggttgaaactagagtgctcctgttagattttttctctgtttttctggttgatctgggaaaagggagtggggagaatgctgagatgactacgcaggtctcaccaagaaaggagtacactggtaaaatgacaatacatttttctttcttctcaaaatcacctcaaaaaattttttctcggccgggcacagtggctcagcctgtaatccccgcacttcaggaagccgaggcaggcagatcatgaggtcaggagatcgagaccatcccagctaacctggtgaaaccccgtctctactaaaaatacaaaaaattagccgggcgtggtagcgggcgcctgtagtcccagccactcgggaggctgaggcaggagaatggcgtgaaccgaggaggcagagcttgcagtgagccgagatgatgccactgcactccagcctgggcgacagagtgagacactgtctcaaaaagaaaaaaaaaaatttttttttctctcccctacctgatgcggtggtcccaagaccacagctgcaactacaagtgctagaacagcaagggtgagttctaggcaaaaaagcctatgtttttaaagctatgtcaaaatttctaagggcagatgggggtggattgtgccttcaccccatctagcaaaattggggctaagagtgaatgcagctatattgcctggtgttgaaaagagctcactagttctgtacctgtgtaaccttaccctatgtgaatgggagtgagatacttgctagacctgtattgaggaggagatacttgctagacttgtattgctacctgcaatctagaccagcatagtggtgattctaatgtcccttccaaaggtgaaaaggtttgggtattaatggacagaaggaaaaataatagctgagagtaaataaataaataaagctgggcacattggctcatgcctctaatcccgaaaccttgggacatcaaggcaggaggactgcttgagcccaggagtttaagaccagcctgggcaacactgggagaccttatctctacaggaaaaaaaaacaaaaacaaaaagtagccaggcatggtagtgcatacctgtggtcccagctactcaggaggctgaggtgggaggatcacttgagcctgggaggttgaagctgcagtaagcagagatcatgccactgcactccagcctatgtgacagagccagaacctctctcaaataaataaatgagttattaattgaggaaaattcaatatcacattaacaagtcaaaagagtctcagggcaagagatgacattttctcgtagctcaattattccagatgcctgaaaaggtgaagctgtgtatttaccgaggccacttctgcttttggaacctgacaagattgagaggaaacctgtaaacccgagtggcctcatcctgggaatcattcgaacagtataatgggctggattgattattaatgattgtgtatgtatgtatacataatcattaataaaacatatattttatgtaaaggatccatggttgaaaaccagaggatggcgtgtggtgttacgctatatattggtttttgtccacagttcctggctccaactcccatagtgcttgttacagttttttgttagaatattgggtgggttagggctgggcacggtggatcacacctgtaatcccagcactttgggaggccgaggcaggtggatcacttgaggtcaagagttcgagaccagcctggccaacatggataaaccccatctgtactaaaaatacaaagttagctgggcatggtggcacgcacttataatcccagttacttgggaggctgaggcaggagaattgcttgaaccctgggggtggaggttgcagtgagccaagattgtgccactgcactccagcttgggcaacagagtgggactccatctcaaaatatatatatatatatatatatttatatatgtgtgtgtgtgtgtgtgtgtatatatatacacacacacacacacatatatggtgggttaagactcaggggcaggcctctgacctcccaccctccttccactctaatgttccccaacctgtctgattatagatcttaagaccttctcatgagagagtaccaccctataccctgggggaaggaatgctgatgtcatgaagcttccattacaacccaagaggacaaggttcagtgagtttctggatagctggaggtttctggagggtggtgcatccagggaggtgcatccatagaagctccgcaccccttccc

SEQ ID NO: 863 - DNA, 8948 bp, Homo sapiens
aaggttgaccatactctacagttgtgttttaatgtatattaatgttactaatgtgttttcagttttattgatagtcttttcagtattattgataatcttgttatttttagtatgattctgtaaaaatgaattaatactaatttttcagatgtatcatctcttaaaatactgtaattgcaatttaataattgtattgaatgccatcaagtttttttaaaaagcttatgcagcattagaggaatttattttaatgcacatttatattcaacatagacattaattcagatttttacttgggataaaacaaattctagttttccctttgttttgaaattacttttaaaatatgtctttacagataaatataaaatatattaagcattttgaacagagcttagaagacaatatttagtactgtttctgaatatttctttatatctgaaggggaaaagccatcaaaatatgtgaattaaatacctaaaattctggttgtcaaaacgtcacacttaaccataactttaaaggtagaaaaacccttacaagtgaccaacccactcattggatagctaaggaaacacaaaactcaaataatttgctacacatcacagattggggtcttagtcttatgtcttctaactttataatggtatactatttttttcatgtttttattaaaatgttttcttaaatccttagccaaagatttttgtttgataagtcaaaaataaggtcttgtttactttgtttacttttttgtattcaagatttaactcagagtaagaccaaattatcattgtagttttattgatataaaatgtcaacataatttaatttttttttttacttttttgtatttttaaaattttttattaaaaataaaagtagacagccaggtgcggtggctcacgcactttgggaagccgaggcaggcggatcaccaggtcaggagatcaagaccatcctggctaacacggtgaaaccccatctctattaaaaatacaaaaaaaatagccaggcgtggtggcgggcgcctgtagtcccagctactcgggaggctgaggcaggagaatggcatgaacctgggaggcggagcttccagtgagctgagatcgcaccactgcactccagcctgggtgacagagggagactctgtctcaacaaaaaaaaaaaaagaaaagaaaagtagagctgggcacagtggctcaagcctgtaatcccagcactttgggaggccgaggagggtggatgacgtgaggtcaggagttcgagaccaacctgaccgacatggtgaaaccccatctctactaaaaatacaaaaaattagccgggcgtggtggcacatgcctgtagtcccagctactcgggagactaaagcaggagaattgtttgaaccggggaggcggaggttgtaatgagcccagatcgcgccattgcaatccagcctggacaacaagagtgaaactccatctcaaaaaaataaattaaaatgtaaaaattaaaactaaataaataaataaaaatagagacagggtctcactatgctgcccaggctggtttcaaactcctgggctcaagcagtcttgccttagccttccactgtgctgggattataggcatgagccaccacccctggcctaatttaattaaaatctgaacaaaaggccgggcacggtggtggcttatgcctgtaatctcaggccaaggcaggtggatcatgtgaggtcaggagttcgagaccagcctgggcaatgtggtgaaaccctgtctctactaaaaataaaaaattagccaggtgtggtggcgggcgtctgtaatcccagctacttgggaggctggggcaggagaatcacttgaacccgggagaatcacttgaattccagtctgggcaacagagcgagactccatcttaacggcaacaacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtggtggctcacacctgttatcccagcactttaggagcctgaggcaggtggatcacaaggtcaagagttcgagaccagcctgaccaacatggtgaaaccccatctcaactaaaaatacaaaacttagctgggcgtggtggcgcgcgcctgtaatcccagctactcaggaggctgagtcaggagaattacttgaatctaggaggtggaggttgcagtgagccgagatcacgccactgcactccagcctggaaaggaggggaaagggaaaggaaaggggaaagggaaagggaaaggggattgtattcgaggctgggcacggtggctcacgcctgtaatcccagcactttgggaggccgaggcgggtggatcctctgaggtcaggagttctagaccagcttggcgaacatggcaaaaccccgtctccactaaaaatgcaaaaattagccaggcatggtggccggggcctgtaatcccagctacatgggaggctgaggcagcagaatcgccttaaccctggaggcagaggttgtaatgagccgagatcatgccactgcactccagactaggcgacacagtgagactgtctcaacaacaacaaaaaagaaattgtattcaaaagcttaaggacctttttgtttaaattctaatttgaagatcaaatattatattaaagttctcattttttatccagcaatattttgttcccaatataccatacatagtggatagaactaaatgccagcgtttgcatggaaacactgtcttggtgcttttaaaaatcatttatcaatctcttaacttgttttatttcctttcaaccattgcatgaaagacttcaccaaatatataatttttgattccactaaaaatattccaggacttaacacaaatgcttagaatatttattgaatgaattacaaagtttacccaatactgtctaatattttttagaacaacccaggagttaggtgttttttgtttctttttctttgtattcctaaatgtatctgaagtcaggttttagaaaattatattcaatctgtcttctaaatgacaagaaaaaatttgcattttacatttaccagatgattctttatatctttaagtgctcttaagtgtgatgaaggatcatttgcagcttttatagctaaatgaagacttttcttatttttaatcctgacaatgaattaaaggaaaattgaaatatttgagaagtaagaaaatataggaaaagtgttgcattaaaacttatagtatgtacattccagtctcttcttagagaagaggaggtggcctgtcgatatctaatgaaaaataacatttaggaaactctcaacagtgctggatgttttatttgtagagttataattttgaaacacataaggagccagcagtaaaatgaaagtttataccttttagtgttaatcttattttggctttttgttttgcaaaacaaactgcacatagttatataggggtatatattaagttttcattttttcttgtttggaaaaaaatactaatctttttcatttaggtttcttttttaattgatgccaaagagttccaatattgaacatcttaagtctgttacttggattacggattgagtttggagcttactcagaggactacaggagagtatccaggaagtagcaagaaatgtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatcccagcccccttgaagcttattaatcttgggggtagaggagtgagtgatggaatgaatggacaaaaaagctggtaggtactatatttggtatgtcagagagtgacaagttctgtggagaaaataaagcagggaaagtgagaatgatgtgataaaggtgtttgtaaggcagaagagagatatttttaaatagtatggtcaggaactaccctacagagaggacatttgaacaaagacctagaaacaataagggagcaaaccatgtaggtacctgggagaagacccttctgagcagatgaaatagcaaatacaaagaccctgaggctgaagcattttttgtgtgtacatggaacagcaaagaggcacatgtagctgtgatcaaatataaacaggaagaatagtagcttataggatcagagagttgataggggccatatcttgtagctgtttaagctacaagatatctgagctacagattcagtttttcatactttgttttgagtgagtgtcgctctgttgcccgtgctagagtgcaatggcatgattctcggctcactgcaacctccgcctcctgggtccaagcaattctcctgcttcaccctcccgagtagctgggattgcaggcacccaccaccatgtccagctaatttttttgtatttttagtagagatggggtttcgccatattggccaggctggtctctagaactcctgacctcgtgattcgcccacctcggcctcccaaagtgctggaattacatgtgtgagccaccaagcccggcccagtttttcatacttctttaagatagttttgacaggtatatgtgccttagcctatttgatgtcggcagataggacagaatatttttatgaatctgatttgagattagaccccccatcagaccaacttagaatacaaacagtgtttaagtggggggttaataggtattgtgtgatgatcaggactttgcaaattttgcattgatggctttgaaagtgttttctgcgtgatcaatttaggtggatccaaaactaatgactccaagaaacactgaatttgctcatgtttgtcatatacccaaatgaaccacagtgtttttgattacttcatccttgaaatttctactataattaagtacttcgttgtttttcacttatttctatttagcagcattttaactagttctttgcctctagctgtttttgttgttgtttttgagagtctcactcggttgctcaaactggagtgcagtggtaccatctcagctcaccgcaacctctgcctcccgggttcaagcgattctcctgcctcagtctcctgcatagctgggattacaggcatctgccaccacacccagctaatttttgtatttttagtagagacggtgtttcactgtgttagccaggctgatctcaaactcctgacctcgtgatccacccacctcggctcccaaactgctgggattacaggcgtgagccaccgtgcccgggtcacctctagctgttttaaactaacaatttcatcttctatatagtatacactacttttttaatcttcctaactttttttttcctatagtatacaatttaaatttctttctttgatgtcttgtggtcttgtcccaacattttctatgttgtttaatttttcttcaaatgaactagtcctaatccatttttctttctctttgcctttatttatgccatttcatcactccagttctcccccaactaatgcctgtacattttttttagtaaggcagaatttctcatgtgcactgtttcttgaccttaacagtctaatattaaccatccttccaatggaatgaacatatgatacctgtagctcataacctttttctctactttcgcacacctgaggtatataacgtttctatcattgtttctcatttattcatataggttaaccttttaaatgtattagcaatatgaaaaaaaagttaaatttaagaaacttcaaaacagtagcctaaacatcaggtcccaaggttcagatattaattttatgctgacaagttatatagttgactttttaaattcttcaaatagttatgtatgaaccagttacaatatatccttaagatttataaacattaaaagaataattatctcagttttccaatattgtaaaagcaattaacagatacactttttaaagaagtaatccatatgtttgttatggtattgtttataaagcattcaataataaaaggctgatgaaataacatgttcagtaggatactgtgcagctacttaaaatagcaagtgaatatttaatgagctaaaaagctgttcattattgaataagtaaaagattatcaaatagttgaatagattcaccagaataattcatatgctaaactgttttactggtttactctgggtgagagataaatcttataggggtgggaggaatcttcttgattataaataagcatgtatgatttctgtgatgggcaaactttgttttttgaaaaggagagagagaaatccttgaaaaataaaagtgattatttgaagcaaccttacatccatataatgatttacttttggaaacctataaaagggaatcctactgtgttgaggaactttagacatgataatgaattaactgtcatggaagaaaaatttcaaaatcagataagtttaaaatcagcttcagaggaacagcgtgctttaagttctcaaagtaatattgaaaaggaattcaagaattacttcttgagttcgtggttgagagatttcactgtcatttccccactcttcaagcccccccagacctcaaaaaaaggtaagtgtaagaaaagggatatttaaatctcttttaatttgaaactatattagtaaacaaactaaagaaatacaaatctggtttattttatagtgataaagatttgataatgcaatgaaacttccatatacaaaaattaagcatttttctgttaagtttaatttttcgtagcataaaagtactatatagacatagaaacctcaggaagagcaaaaaaaaattatttaaaaatcatttttatcatccaaaagcagttgttattagccttatatatacacccttctagttgcatatttggattagtgaatttatttctcaatccaattcgttactgtgccagggactagaaagattatatttcctctagagaagaggtttagtgctatgcttctggctcagaaatattttctttagatttgagttttatctaaaaattaccactaactttatatctattccatagtattgtaatgtaaaaatgcctaggattagaatttttcctcaagattgaggatacaggaagatgcatcttgtttactctggattcctcctctaccatatccgcatgtcatccccaaggataccttttcatagtgaaaacaatttgaggcaagggaggtcatgaagtattctgagcaggagagtaagaaaaataacttctgaaatacgtgtactggtcagaatttgcttaaagagagaaatctggccgtggtggctcacacctgtaatcccagcactttgggaggctgaggctggcgaatcaccagagttcaagagttcaagaccagcctgggcaacatggcgagaccccatctctactaaaaatacaaaaattagccgtgcatggtggtgcacgcctgtagtccctgctacgtggtggggggctgaggcaggagaattgcttgaacctgggaggtggaggttgcagtgggct

SEQ ID NO: 864 - DNA, 4967 bp, Homo sapiens
tgtttcccggacttctcagataaaccctctgcaatctcttgggttcctttctccgttccttctttaagaacattctcaaagctttcgtctattggcatcggcttggtctccacatctgcttttgttatttcttggtcttcaatttcaatttctaaggattcctcaattggaagtgacacctccccatcctgacttgatgatttcttcatggagcagtggaaagaacgtagtccagaaattagaaggttttggtccatggcacagctgagcactgacaacacatccttccctgggcttattccatctgagagggagatgcacatgtatgatttcttctacggtcattctgaagatcggtgtcatcaataatttgggcttgggactatccagtttcacaggggcattcagttgattgaaaatccaatatcaatattgtttatagtatcaaaacaatctaccgatcaaagtctctaaaattactacaaaaacctatttgatatcctatggcattgcccaatttaaattatttataaaatatgcagtaaatgtgtatgccagaaaatcaatgtcctaggcattgactcctaattaattgtttgaaatattttcataatagtgaatgagcacagtgtttgcctgacctctacgaggaagaggaggaagtagaagcagaacaaaggaaaggaggaagaggaagagaaataagaaaggctgagagggttgaaagactttaaggggggctagtaagaaaattgtaggcctctagaattgtacacaggccagcctttccttctcatctacttcactttcctaaaaatcaattttaagctagacaaaaaatgtgcagagaccaactttaagtggatccaaggcagtaatttgagctgattccatcaaattatagatgcatgagaagcatgcattttctaaagaataacaacgctgcaacaaacatttttgaaggaactactaaaatatttccatctctaaactcatcctcttccacttcagatgatttcttttccatttcattctattctctgaagcaaaaaccagaggaaagaaatctgatggaatgaaattctgctagcaaccatctgaaagtataaatgagggagaaagtccaagatttaaaaattcaagcaaattttcttgcctgttggaaggaagagctctcaaataaagagataatcaagagacatattacagggcatcaagagccatgaaagtaaatcagcaaactggataatttcttgcagattagaaacatctccctgaatcacagttgaagcaaaggggatgatgccaggtctgactcctacttggaaaatcataatcccatgtttcctcttgcctgggcaactgtggagctgtgacatgcctgtgtgcagcccactgcacaatcagcagacctcaggcaaatccagctccaagctgcacctagcacctttaatgaagtgactgattaaataaaagcatcccccttttgttaagcaatactttctgaagcagcatggatttagaggcagccctgtgagtttgtaggcgataagcactatataaatactaggtaatagtgggattagagtcagggaaagacctgtgtcctgtgtatgaaatgagaaactggaaggagaaacttttaaagagaaaaatacaggaaaaggcagccctttatccttttcatttcctcttattcatatttctttctgctaaagcttatttctgatggtaaaatctcttttctcttgggtctcattatttcattctctttttaaaaaatattccctaattattgcaaccaagtaaattttttctaacaaacagaaggcccaagtgacagctcgtgattaaatatacacactaggaaacaaacagtagtttctttcaattgactgaactgcctctatacttaccatcttgcaaagatataatgaccagagacaaatgaaactttaataaggtttctcggccctttctgctatcctcaagtaagtatcaaaaccttccatgaaaattcagttccatttgaagaacaggaacaaggcctcatgcccctgcataactaaagctcttctttctgatttccttcaccagttgcttatgactttccttctcatttcttttcagatttctcaggcaagtacaactgagctgataaagaaacagcaagcccattgagtggttaacccatcagtcattatatatttgcaacatttagcattgaattgatatactaagttttcactgaaatctcttttatccatgcccacacaaacagtatagtgtcaaagggcctgttcttgttgatagtgttgggtaataactcctctccatcttcttcacgaagccctggtgaattctggacatcaagtagggtgaccatgaaatttatcatccaaacttggacacatagtgaaagaagtgttactaaaaattaggaaatgggggggaaaggggcagaattttgaactattccaggaaaactgagaagtatggtcgccctacgaattagtctccccacttctagtctgatatccctcaaaatctccctcctgttggaaatcagagtgatctattgttattaaacagatcatgtgactctcctgcttaaagccctccagtgattcccattatccatgggataagttccaacattccccaggcaacataaaatgtgttatattttctaatacctactatctcccagtgattgcaatttctcatgctacatttaaatgtctggcaacggaactgattgtagtggcccaaacactatcaactacttttaatctccaggcctctacaactgtatgagtcacatgatattggaactattcccttgtattatctctctctcagtagataaggatgacgtcctagtgatcttcatgcccccagtaacttgccagtgctgatgcttagtaaggacctaattaacattgatccaactggacacagacatggaacaattaggcattccatattctgtcctttccatattctgataaagctacagtaggttggttctaccctatataggaagcttgctacatttatagaaactcaatagttaccagaacaggaaaactgattcacagtgtcttgttaaaccaaacaccaattttggttactattccttgataaagattgatacaaaaccagcctgaccataaaaagtggcaatccccatgttgatgctggtggccctagagagagaaagtctgacacaagccagaggaagagtgttcatatcccaaagacttaggaagcagctggttgtatgaaaacctcacagcactacattacacatgttcttccctttctcttctctttctctctggttttgcctcccagtttgcttttagtatagttactcttttcattttcttttgggccatttttcttactactgtgtaaactttacctcatgcttattcctaatgtgcccagaaacacctcaatccttacagaggcatcagagctctagattttcaggatctctctcacctgttccttcccacagaaatgataataagggttcctgctcacatttcctcccccactccctctgcttcctaacctactctggtgcttccttgtgtagctctgcatggtgtggtgtaagagttattaacattattgaagatggggtcttgctgtgttgcctaggctggagtgcagtggtgcaatcatagtggtgcaatcactacagccttaaactcctgggcccaagccaacctcctgcctcagcctccttgatagctgggattacaggtgttagagattgggtcttgtatgttggccagtctggtatcaaactcctgacctcaagtgatcctcttgcctcagcctttcaagtcactaggattacagatgtgagccactgcacctgatcttgtgatggttaattttacctattaatttagccggactccaatgcccagattggtaaacattattctggatggatccctgaccaatgcatgtggtgtgtcccctcctcttgggaactgtgagtaacaatctatctttttgatggcaattgtctcttaatctgtaagtttcaccatacctgaataatttttaaaaacccacattttaaaatagccatgcagaacaatatacctactttcattaagaaagggccaactagtgaaggtttcaagcagtagaggagcatgttgagagtttttccataaagtttaatttagcaccattatgtagaatctaataaaaccgagatgaattttgcttattcctttttcccctttctgcttttcaatctcagttccctggttctatctgctaacttcctactgatcattcaaagcccatttcaaatgccaccttctctaggaggcattctctaatctcctcggtcaaaactaatatttctttcctctatgtttctattgtgctttatttatatcacaattatagtactcatcacaatatatcatggttaattgtatatatatatatctgtctctcttgctagactgcagtctttctgagagaaacagtttagtcttacccatcttggtaacctcaggacctagcatatcatttgccattatcaacaaaaactggactgagctatattctcatttagaggcaggacaagtatatagatgattgcaatagttccattaaaagattagttatcaagcccctgaactagagatgtagcagtaaggatgaaaaaggattatcaggtacatgagccactgttcaggtggcatctagagctgtgccatccaggacagcagccacttctcccatttggatgctgggcatttgaaaggtagctcatttgctgtaagtataaaatattcattgaatatcaaagacatagtataagaaaatacatcatacttaattaaaatttttcatattgattacaggtggaaatgatattttagatatacttgattaaataaaatatattaaagtcttaaaattta

SEQ ID NO: 865 - DNA, 4493 bp, Homo sapiens
gcgctgtggaaccgcctcctgctagagcagcgggctggcgacggtcctcgccggggcgggaagcggctcaggctgccctcgctggcctgcggcggcgcggctggaagcgcgggccactcgtgcgtgggtcactcaggactgcgcctcgcgcgactgtgtgtgcaggaaacaagcaggaaataccctaaaagagaatgaagcgccatgttgagggtcgcggacgtcgcgagtgctgtgggaatgtgggctgaggtggagagttatggtagcccgtgttacaggctcaggggtctgaaagaagcctaatcgtggaggcggcatctgaggagggtcttgaaggctgggcaggcatttgcccgacagagatggaggaagctagtcctgtctgatggaggaaacagggcggaggcgtggagggagccgtgcagcgctggtgtgaggagcagcgagcaggccaggcctgtaaagcagagtgagggaaccaggatagagaaggcaagtcggggtcctgtggtcgctgaagaatttgaatgaaatcagtaaacaggtgagagggatccatcgcaagagcatgggatgaaaggaggagtagtccacggtgattcctctgcagcggtgggtgttattaatcgcgtatgtgacaccaaaaccaccccactcaagctgtggctctttccctaaagtagaaaaccgagaccagttgggttccaagcatccacgaagatcttattaaattcgtgatccctggtggcaccatggagtcaggattggctcatctcaaacctgactcagaaacaaaaccgtcacaatgtgcagagatgagcgtccttaccgctatcaacgtattttctggtgttttcacagtgctgcgcttcctaatccccattccatggcaatccacatgccatgatgcccggagtcattaacaaaggagacacacaggggctcctcacgttggctttccagggttttgatgaaaatctgtttcctcgtctcatacaatgtggttagtaatagtatcatttagggttgaagaattaaatggtacgagttatatagggtgcttattataacctacatggaaaatgcctaggatatgttagctatgctcatcaccaacatcgttatatgatggtaataatcagatagtcaggaagcctgacaccaagaaaatggatacatgctctgaaggaatgaatgtggagagatcagaaggtcaagaacaaagtcgtacaatatgtctacagtaaagggatagagaaaagaaaggctataaaagaaggaatgaaacagagttaaattatagaaatcaaagctaaggagaatttccagaaagggtagtatcatttaatatcatagaagtttaggagcccaagatggaaaaaaggcctctgggtaactgacattgaggcagtctttggggaagctccatttccgatagagaagtagactgaaagtcagcttgaagcagggactaggtgaagaagctgttggctggtcgcatggggaaataaataagggatggcatatgccgtatttctggatttctttctttcttgcccagcctctatatatgcacagagtttggcgaaaacttacaaaaaataaaaatgaaaccaatttcgtttgtagacccaaatacaatgctttctgttagaatcaagataaattcatgcctctcccttctattcaaaccgtcagttttgaaattaaacatcagcttttcttcttcattaaaatcattttcagctcttcccattgatggtttgggggagttgcataagcagtcaggtcttgatgagtagaggaggagggaacaaacactttcagcaaaggcagaattctgaaattctgctcatatttttttccagtaactttcctatgtttgtgaggttattcagtcataaagatcctagtgaaatgtttttcaagctttactaatcataatcactgtggacatttgtttaaaatgtgtattcccaggcctctcacctggtgattctgattcaggagatcatggatgggactcagcatacatgtgtttgacaagtatcacaagtggttcttatggtcaggcaaatttgggaaactaaccaggaatttatgtttttatgactggcagctagaaaagattcctagagtctttgctttttgaaaataaaatatttcttttttaaaaggaaaattgtatgactagatacagcatttatacatgtgataaatgtactatactgtgtgcttttgtcatatttacagttaaagatgtgtaagaacactctgagaaaaattgtatattaaatgaaaagaggggtaagtcagggtgggggagaaatgagaagggtgtgcttattgttgctaaaagttagaaaagccagaatgatagcatctaaggttgcaaatagcacactgtaagttgagggagcttcacaatcatgtctgaagccttctttgatatgctgagttgtaaacagtggctttggacaagatttgagggagaaaccaactatgctttaaagtgttcatttaaaagtctttaattaaaggaaagtctttgcatttacttgagctaatttaacttcaggactttaagaaattactagcccttaacctcttaaaaattgtctttcatttcaaatgaaagtttaaggtggcctttatgttcgattggtatacttgtgcgaagacttaacagcaaggtactgtacaattctaaatgtttacttcttaattttgctggaagaaatatactactcaattgattatttttaaagcaaagtaaaacaatttattttgacaagtgacactgtattttcctagttttttggtggcaaagattagtcttaacatcactaatcatcagagaaatgcaaatcaaaaccaaaacgagataccatcctacaccagtcagaatagctactattcaaaaattgaaaaacaacagatcttgggaggctgtggagaaaggggaacatttacacataattggtgcaaatgtaaattagttcagccactgttcaaagcggtttggaaatttctcaaagcatttaaaatagaattaccattcaagccaacaattccattactggtatataacccaaagagaatcagttattctaccaaaaagacatatgcacttgcatgttcatcgcagcactattcacaatagcaaagacatggagtcagcctaggtgcccatcgacagtggattggatcaataaaatgtggtacatctacacagtatgattaggccattcttgcattgctatgaagaaatacctgaggctgggtaatttataaggaaaagagatttaattggctcacatctctgcaggctgtacaggaagcatggtgatggcatctgcatggcgcctgtggaggccccagggagcttttactcatgatggaaggcacagagggagtaggcacatcacatggtccgaggaggagcaagagaaaatgggagtggggcatgcctcgggcggttcagctctgttgacactcatggtgctgcttgtgggctgatgcaggagtctactgtgaagggactcagtatggtggaaaaaaatattcaacttctgctcactttattcagtgtaagaactgtaaggaggactttctgcatataataccattatggcctgggggaggagtatcacagtcacagagtactggttcccttactgtccaagcatggttctactctttgcagtccaaaggggcttcatagactgactcatgtattcagggttcgttagctcttgtaaaggtaattttatatgtggatagttgttcatatagatgtgtccgtaggggtaagattactggagagatcgactccactaccttgctctgcccaaatccttcccctttccaacaagagtttgccacctcctagttttcttttttcttaaccaaactaagtttagccttttaatccttaactctcctccacttctaatgccattgcttctttgtatgcttattgtattttccatgctatatgactttcagctggttatttacagtatgtaagttttaatatcctgtaaaagggggataataatagcatccatttgatagggatgttaaagatattaaatgacactgtccatgttaaataactttttaagatatattgagatgtttctgtacttccttgttctggccttcttgttgaaccagagaaatctattgccatgaaaagcaataaaattgtgatagtagaaattaaaagtgagtaggaacttatttaaaaatcatcattctccttttcaatgcaaaaataagaactagaaacttttaataaggcaatagtctgaagaaataacttatggaagagaacatgggttttttaatcctaaagggttcttttatatattcaagggtcgagattgcctgccttgtatcctactaaaatttcaatgcaagtttcagagagggaggaaagagtcaaagaaaaaattgcactggaaaaagttaaataagtaaggaag

SEQ ID NO: 866 - DNA, 3503 bp, Homo sapiens
ggggagcccagacttgccaatgggtaagtgagtctagtcaagatgtaggatttcagaaaactcactcagaagagcaggatgaagataaaggaggcatcattcagcagcaataaccaactcatttccttctctagaaagcaatgaaacaagaatctggtcatgggattttaccagtgcaaaggattaatccacccaattgatggccaagaaaccaaccagtgagagcaggaagcaagaacacctcgagacaggaggcatggctgggaggcctcaggaaacgtataatcatggcagaaggcaaaggggaagctgtatcttgtaataagttaaatatttgctgaaggaagagagctgtaatagaaaatggaagtgccagtggtgagactttatttttttttctgaggaatggttgaaatacatgaagatacatagagaagaaaacaattcttaataagtgctaagtgtcatcaaatactatgtttaaatgaactcctactgaagagagattagatttttttcatctattttgttaagaaaacaattgaagatcaacaagtagaagtaaggagtagactcttcagatacatggatttctaatagtagagttgctccagctggactcactcaaataaaatgagttccaaattcccagggatgtgcaaacattgaataaacaatgaactgccaagattaggtagtacaaagctcatagatgattcctgttcccatattgcataggtctcctttggattcagaaagacaatgaactgccaagattaggtagtacaaagctcatagatgattcctgttcccatattacataggtctcctttggattcagaaagacactgggcttcccccaaaccaaaggagaatagtgcccctcccactcacatccagaggcgtacatctactgcataggagttgctttcattttcctctttataaattgttttgtcttattctaaattcactaaagaatgatgattttcagaaatgtaacaatatcaggtggaagtatagttatgtagtagtatagcacaagttaagctaattaaaagatatcactgatatatatcaaaatagaaacacatgcaaaaatgacaatacttatttttgttggggatgcagagaaaatagtactctaaaaactcctagagtgaatatgcattgttatatctttaatttttaagccatgataaagagggtattaaaatttaatgtacatacactttttcatcaagcaatactttatatctagaaatgtatgttatagaaaccaaagggttactagtagagacctatgaataaataattttcttgcattagatattagaaaaatacccaaacatgataaagtagttattcaaattatggtacatctataccatggatgttcatgaatgcaaccattagatacaaccccgtcataaaaccatcagatctcatgagacttattcattatcaagagaacagcatgagaaaaacccatccccgtgattcagttacctcctaccaagtccctaccatgacacatggggattatgggagctacagttcaaaatgagattggactagggacacagccaaaccataacagacatcaaactatttatcttcacaaatgatataatttcacacctagaaaacctcatagtctctgcaaaaaggctcctaggcctaataacttcagcaaagtttcaaaatataaaatcaatgtacaaaaatcagtagcatttctatacaccaataacatccaagctgacagcaaaatcaaaaatgaaatcccattcactatagccacatacaaaaaatacctaggaatatggctcaccagggagatgaaacatctctagaataagaattataaaactctgctgaaagaaatcagagatggcataaagaaatggaaaaacattccatgctcttcgatagaaagaatcagtattttttaaatggccatactgcccaaagcaatttcacagattcaatgctatttctatcaaactaccaattacatttttcacagaattagaataaactatttcaaatgtcatatagaaccaaaaaaaagcttgaatagctaaagcaatcctaaggaaaaaaaaatgaaacaaagatgaaggcctcatgatacctaactttaaaatacattacagggctacagtaaccaaaacagcatagtactggtacaaaaacagacacatagactaatacaacaggttagagatcccagaaagaaagccataaacctacaaccatctgatctttgacaaaactgacaaaaacaagcaacaggtaaaagactccatattcaacaaatgatgctgggataactggctaatcatatgcagaagattgaaattagattctttcctttcaccatttataaaaatcaactcaagatagattaaagacctaaatggaaaacctcaaactgtaaaaactctaaaaggaaacctaggaaatatcaccttggacagaggccctgacaaagattttatgacaaagctttcaaaagcctttgcaacaaaaacaaaaattgacaaatgggacctaattaaactaaagagcttctgcacaacaacaaaaattgagtaaacagataatctacagaatgggagaaaatatttgcaaattttgcatcccacaaaggtctaatatgaagaatatataaagaacttcaacaaattaacaaacaaggagtgaacaaccctatccaaaaatgtgcaaagaagacgaacagacacttctcaaaggaagacatatgtggccaaaaaacatatgagaaaaaaatgcttatcatcacaaatatttagagaaatgcaagtcaaaaccacagtgagataccatctcataccagtcagaatggctattactgaaaagtcaaaaataacattctggtgaggtcctgaagaaaagggaaaactgatacactgctagtaggaatgtacattaatttagccacagtgtaaagaagtttggagatctttcaaagaacttcctcaaagaacacacatatattcattgcgacactattcacagtagcaaagacagcaaagacatgggatcaaccttgatgctgatcaatggtggactggataaggaaaatgtggtacttatacaccatgcaatactatgcagccataaaaaaagaacaaaagcatgtcctttgcagggacatggatagagccagaggccattatcctaagtcaattaacacaggaacagaaaaccaaatactgcatgttctcactgctaagcaggagttaaacattgagaacacttggacaaaaagaaaggaacagtagacgtcgggcctactggagggtggagggtaggaggagagtgagaactgaaaaactacctatctgatactatgttcattacctgggtgatgaaataatctgtacacaaaactcccatgacaggcagtttacccatgtagcaaacctgcatatgtactccttgaacctaaaataaaaattgaaaaaaaaaagcca

SEQ ID NO: 867 - DNA, 1436 bp, Homo sapiens
gtcccatcgagaagcctcgggtgaggggcccggtgggcgcccggaggccgctggagggctgtgggagggacggtggctccccactcccgtggcgaagggcaggcaaaccagaagcctcttttgagagccgtttgggattgagacgacttcccagagaccgtgacaaaagacatcattctacgctgcacaaaagcagccagaggcggcctctcccacgctccgggagcgaagggaatgatctggctagagagcagcactccagggtgactccgtcctgctgtctaaccggcctccggcagagtggcagatcatctgactctctgaaccactctgaacatcagtctcttcatctctaaatgagggtgctggccgtgtggatccgcaggggtatcctgaggtttgccacgtacaaaaagcttaggacagtaaatactaataggctggtgcaaaataaattgcgtttttgtcactaaaaaaaagtagcaaaacccgcaattattttccaccaacctaatattaaatgtgagtgactgggtcaacttgatgcagctttctgatccctgctcaacctgcgaccagcttctagaaggacaggagtggcctgtggccgtgggtcttaagggcaagagaacaacagagagatgtttctggcccctcttgtgtgaaatgaagactttttaatgtgaatgtagaagtaagtcttgggagcaaaaacaaaatcagaccctggagaatggcagaaactccaaaggagttgaatgctggagaaccccaggcgaagttaaatcaactcgacagaagagcacagacatgtgatggggcaccaggtgggggtgacaggacggcacaagctgccttctggggtgatggaatgctctgtagcttgctcaggatgtggggtactcacaaacgagcactggtcagaactcattgaatggtagcacttgagatctgaccagttcaatacatgctcactagacctcactctaaaaaaggaaaaggagaaaaaaaaaaagagttagaaactaagggctagaggaaatatgtgacagacaaggaaaggcttctgtaagcagaatgtgtcttttccatggggaaatatgaacgatatgtctatacacatgtgcacatatgaacatgaatctgtgaatgtgcacacacatgcatacacatgtacatgcacacatacgcacaaatgcatgtgtgtacacccgcgtgggagcgtatacacatgtacatgagcacgtatgcacaaatgcatgtgtgtacacccacgtaggagcatatacataagtacatacacatgtacacacaaatgcatgtgtgtgcacccgcatgagagtgtatacatatgtacatgcacaaatgcatgtgtgtacacccgtgtgggagtatatacagatgtacatgcacaaatgcatgtgtgtacacccgca

SEQ ID NO: 868 - DNA, 2779 bp, Homo sapiens
agaaatcctccagccctgttagaaatgcctcagccagggggactcatctcctcaaacctgggggaccgagacctatgagaggtcacagcatgagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaagacctaatagccaataagatagtattaatagatggggcctttgggaggtgagtggctcatgagggcagagtcctcaaaaccagataagtgcccgaataaaaggggccccagagagatcccttgcaccgtctaccatgtgaagtgtagaacacagcgagaaggccacctatgagccagaacgtgggccctcaccagaacccagttgtgctggcaccctgatcctggacttccagcctccaaaatgacgacaaagaagtttgtttttcctgagccatccacttcaaagtattctgtcatagctccccaaatagactaagacatctacttaaccttggtcaaacgtttaaccttggagtccacgcctctgaaatggtgacaataacactgtgtatttcctactttatgatcaggattaataaatgtaatttattaatcagaaattagtaatttctgattattaattctatggtgcttgatacttgattgaggcttatttaatatttggatctcttttaatttttttcttttttgctctttctttctgcttttcctcttccccttttcctattgaaatagaatgcagaggataaagcaagcaaacaaaaaaacttccagaagaatcacagagttttagacctagaaaaaaactgaaaaatcatccattccactctcctcattttacagatgagggcatcgagcctcagagaaatgaaacttgcccaagaccacacagcaaagagacgtattttaaagaattggctcgtgggattgtggggcctggaaatctgaaatctgcagagaaagccagcaggctggaaattcaggaagtggcgaggaaagaagaatgaagacaaagaatatggagtttccattgatttagccaagtccataacagaagaaaagtgccttccttcggaacttccaatacaatgtgtgagaatggacctgttacaacttgtattactcgcagggttcccccactaccaagaataggggtggccttagaaggcactctgaagcaagaatcagcaagtgactgaatctatgagactcgtattgatcagcctcaaaagaaatgagtcctaccttctcggtctcttaagaaattcattctcttgaaaagcaattcaaaaagagctttccctaatacacattagataaacaatgagatatcctcctagctttctcttgggaaactttcactttatatcttttcaatttattctcatctttttttttgttccttccttccctacttttaggctttgtcgttcaaaagctagctcgtagaatttttttaaatctttgtattcatatatccctaactagagcatgatctttttctggctggtggatcctccccagaatgtttgcatgtattagggctccagtgaataggtgttggtcatgaggaaggatgaccagctaagggagctaatggcttagacagacactgtagaattgcaaggaatagagatgtgctcaagataccttggttggcgaggtttattgttgcagaaacacactgggtggtagccagtcaaccaagacggcggccatcaattccttacctttctttgtgtacatgctgcaccccatgaccaaaggtagggccttttttctcctcccttgtatttcgactggcctcataccttgctttcaacagtgaaatgtaacagtggtgaagttggacttgttccaagcctagactttaagccttctgtttcctacttcttagaagccagtcaccatgcaagaagcctgcctacccagtaaccagctgtgagaagtccaagctggctacacaaagggggggacactgaggtgccagacaggtgggtaaggcctgcctgaaccttccagctctgcccaacactcagctgaatgcagtgaatcagccagcccagctgagaacacagtgagcagaggttctgatcctgcctggattccagacccacagaatccagagaaatcatgtgactttaagccactaacttttgcaatagattaatgtacaacaatagataaaacacacagaaaagtcaagaaaatgtttttgaagaaaagtgatctccgtaggttaactgcagttggttaatactaatttattgtatatttcaaaatagctagaagataataattagaatgttcctagcataaagaaaagacaatttaaggtgatggatatgccaattacactgatttgatctttacacattatatgaatgtattcaattatcacatgtaccctgaaaatatgtacatctattatgtgtaataaaaataaatcaaaactttttaaagaataaaaagcggtcgcacatctaaacagggc

SEQ ID NO: 869 - DNA, 7970 bp, Homo sapiens
ttttgcaactacaaagggcccagagtttcccttgtgaatgagctcagcatcctcacgtttccaagaggaatcaacactgcaattcctcggaccacggtggctctcttcccagcacacctttgctgtgacctgcacccctgcattgtcctcaaagacacactaagaaaacacatttcagaaggaaggacgtaacggagctcatgatcctatgctccccagttggactccatgggatactgtttcatatcttgttctaataggctcttcttttccagagttttttattttccctggcattttgtgttttggtaattgcctacaagaatagttctataacagaaatcaacaatgaaaaccaaattacccctgcccacatcctttcattcctttttcatctctaatgatattttctgtatgatgactaacccagactgacgtaatttatcaattgatcttgacgatgtacattagaaaatgcattctgcaggccccagcaggccatcttccatgtgcgccacgtagctttagaaaacctattagtgcaacagaaatatctaaagcccagcctttttgctaagaatattagaactggtgctaattactttattaatcataaagtgaaacagccgtgctatgtcaccacagccgtaaaataagtggttttatggcaaaagtagttaaagagaaaggacagattggatttatatcatgtttatctaccatttattaagtatcttaatcatatctcctccacagagaagcaaacatccccctattcaaggttaaaagaagcgtttgtctttgaagccccactagagcagttatctctagtgaactagggtttttaatggcctttcacaataattacaaatttaattaacctctctgctttgatcagtcacggctgtttctcattaccttccccaatgcctgtttctgagtcaagagctattcctgggccttccctttccagctataaagtactgtttaggtttaatttagtctggcacagctgtaaagaaagcaactctcctgctcaacagcctccaatgactccccgttgaccactgaattaagtacaaactccttagcccggcatttgggccttccacagtctggccccagacccccttctaatctcatcccaactcttttttaagcaatcctatctttccttaccatctttcaaatttattaaattcttacatacatcaagacttacttctaacttgtctattctcttcagttgaactgtcagtttcagtgccagtcccatgctgttttacatattataactttataatatattttaatgcctgatgaggctaatgctagtatctcctcattacttttattttgccaaaatatttgtcagtatacttacccatttatttttttcagatgaacttcagatctcctttgttacatttcaaaagaatatctcttgatatcttagttatgattggggaagaactggcatcttcctttgtacaaacccctggactatatgaatgaaatgaagatgagtaatctgccaggaagatttggagatcaaatcctagacttctaactcttggaagtctatgtgacaaggaaggtaaacaaatggaaaactttagtaggaatatttttctcctcactctttttcttacatgtcactgatctctaagacttcatgacttgccttttcttgatgcttcccgcacagctgttttctttttcctcaccaccagcccccgagcacgcacagtggaggaatgagagaagcttacataaaaataactttctggaggctgaagtccaaggtcaaggtcaaagagccacatctggtgagggccttcctgctggtggggactctgcagaaccctgaagcattgcagggcatcacatggtgggggagcttgagcacaccaaactggcttttactagagacccactctcatgataactaacccactcctgtgataacccattaattaattaacccttaatagattaatccattgaatgggaagatgtgcctacttcccctttgccttccaccgtgactgtacatttcctgaggactccctagccatgctttctgtacagcctgctgaactgcaaggacctggaaatcagacacacctgggttcctggtgagcttcactgcttcctggtctctgatatcagctctgcccaaatttcagctgtcacagaatgagtgatcctcatagtataatggaaatgcatcatctcagtttccccatggcctgaatgtccatacaaaatgagagccagtagagaaaaacagaggacgtgaggagtttttaaaaattgaggaaaagtggaaggaaaagtaaggatgaaggtgaagatgaaggaatatgtcagagatgctagcactggcatcccccaccacacagtaccatgtactgctaaagaactctagaacatacagggtgtagacggcagtcttcttggggaaaaagaggcttcaggattgcaagatttcagctactgtctctcctcggagcaggattccatcttttccatggctggggcccttgacacatgtcactgtgcactgctcttctcgctggggaaaaggaaactgaggcccagagagggcaagtgaatttcccaagagtgtccagatgatacggagctgagctggaaagtgagcctggatctctctggttctgaaagctttgctcgaaagcacaggatgacacctccattgacttgaatcttgctttctgacatgctggctgtggcttgcttgggacctgaataagagcttgcttactcccggtgttcaccacagcggaaccatgggtgcagaaatgtaattctctgcactatctttctggaattgggaggggcacagaagcaggaaaagtgaattccaggaaagttgttgcatgttggaagctgtgttgtggggaagtgacaagttgcttgctatctgaatggggatgggatcctttgtgaaggcagcatgaatcaccaacaggtaggattagatggatgatggttgtatttggaattgtagccacacccttgggactgcagccctgtgaagactgaggttctgacgaaagtcaagaaaaatctgcattgcaactcttcgaagagaagaatgtgacatcttgagtgggtgaattttactttcttcttgatagtgttttaaaatttttagaaatgttttgcaatgtcttaaaagtgaccttctacccagaatttggttaatgttcagttttatttccttcttatttttctgagtatttactttttcaattcagctgaaacttttcaagaataccatgacctttctctccttttaaaaaaaaagtttcaaacagacaatgttaaaacagaagaagttttggaaatcaactacttaatctattatgatatggaaactgtaaactaaaactgttcatatccactccccaagattacatcaagagtggcagggctgggacaccagagtttccggaatggctcctcagggctccagctgcaacaaactcgctgtgccaatgtgcatgcagttcctgattctaatcaaataagtatcataaccgagttcacccgaaatagagtatactgcacagaaacttaataatgggtgagaaagacacattcgtgacattagcaattattaccatacgtggtcaaatccatttttattttctgttttctcattttgtgagtcctctgggatctacacacaggtaccaattttttgcctattcctggcaccgcgcactgcttaatcatcctccccacactgactttgttgaccatgctcgattgtcaataccaatagttctccaggggtggctcagatacccacaggggtccctgagatcctttaaggggtctgcgagatcaaaacaattttcataatatgtcgttttccagaggcagctgcataaatcacaggagactgaatacaggagaagatgtaagaatccagtcagcttctatcaaaccagacataaaagacatttgcagatatgtaaaacaatgccactcttcacattgcatttttaaaaaatattatttcccagaaaatatatcatctatgttaatatggaatggggtttgttagaaacctctttaaatttcaagtaattaacaatttaaaaggcagatatctagagctataggagtacaattaatgaggactcagtcttcaaagtccaaagcgagagcagatggagaaacagttctcagcatttggtgttctgcgagccctcatgggaggaagaatttgttccagcataaagagacgtaagaacgagtactaggaggcaaaggagacagcattgataaaccaagataaagacatctaaatagggctgagcatggagactcatgctcgtaatgctagtgctttgggatgccaaggcaggagaatcacttgaggctgggagtttgagactgacctgggcaacatagtgagacgctgtctctacaaaaaataaatataattagccagggatgatggtatgttgcagaagtggaatttattcataatttatgcaacaaatactcatgatgttcaaggttctggtgtgcaacagtaaacttacattccctcactttaggttagtgagaatgaaagataataaaaaacaaaaaatatatataattcaagtggatgtaagtgttgtgaagaaaatacaccagtgatcataatagaaatgcaatctattctcggcttgtcattatattttaatctttttatggccttttgttctgatattggtacataaaagtttaaatcctaatgtattaaaaaagtttaatatcactataatttcagaactttatatcatgcttatcataccatcccatagtatgggggactacaggtgtgcaccatcatggccagctaactttgtactgtctgtagagacggaattttgctatgttacccaggctggtctcaaacccgagggctcaagcaatcctcctgcctcagcctcccaaagtcctgggattaaaggcatgagtcaccatgcccagccagtggttgaaactcttattatggccattctgcggatgagaagactgagtcatcaggaggcagggcttgccaaggtcactgtgttggggaaacacagtcaggatatgaactcaggctcttggggtccctgctggtcactgtcaccccgtggcccttctgaagaatgtcacaggaaagcaaagctgagagggcctcgtgaactcatccatgcctgtctcccacactgacctgcacctttggtcccagaggtgcttatgaaagacagatgctcagatccctccttagagagtcagattcaggaggtctgatgtgaatcccagagacctggaattttactgatggcccagataatttttatggtcagatactgacctaattccacccagtttcccactaaattttgtaagtgaggaaagcaatgcagaagagttacaggaaggcccagtgttacatgcccaggtcatggcccagggccaagccagccccaaaggtgggaccctggttctcttagccttccctgacacctgtcaccctggctgctgctccagggaaccctctctcgggagaagcttgagcaaatgttgatcttcccagaacaggggtctacagaatccagaggtgtggaaacagtgggatgctaatagctgttagaattttggttcatccatagatccaaactttgaagcattgagacaaaagatagctgtgctttgatagagaaaatagataagaaaagggtgtgaaatctgagtgtcacagaagaaaaaggaagagatgacaaaagaacccggcagttcctaggagcccagccccgggcaagctctttctccatgtgttatttcatttaatcctgaaaacaacgttattaattcctatcattggtgctttacagatgagaaaaccacagctttgactgattaaatcatagcctttcttaacaccatgaattatactttgggaaatagtactccagagaagttcttctcaaccaaagagtcaggatccaggggaatagggggctaagcgtggactggaggaatgaagacacttggcttccagctttttgtatgtcagtctccttggtccacaccacagagctcctttggacatcattatatccgcaagatgtaatcattacatcttctcaggccaagcaaggtacaaagtgccaaaatcttaaaagagggggcattggatagaaaatattggacaacctcttttcctaagagaagaagatctttagaagaaaataaagctatttatacctctgtttctaaatacaaccatttttatacctgccctggagttggttcccagaagaggatacccattccatggctttctttgaattggcatttctaacttcaaactagaggaattagtcaaagttctttaacacactaaaccacccataggaatggaactcaccaatataggggacaggcaagcgggtttctgggttctttagtcattgacaagggttaacagcttaaaggttattggggtttctggctacacgctaagagtcctgcttcctaatgtaagctcccctcccccacattctttaaacacattacttcctcaagcacttcctctggcttaggggcggggttggggggagaaggatgcaaatttatctaatctctaaaaaaaacctctggtatttgtgcagtgagtttcaggctgaagagaagagagagacctgcggctgtttccgcccactcgtcccagcacagccaccagagaacgccgcgtggtttgttgtttggaccctcccagagcctcttccagatgctgttggaaaaaaagaaaagaaaagctgggcagccagtgtcacagcccagatgccatctcggtctatccgcggaaatgcaagcacgcagcgccaagcccaacccagtaggtgccaggccctgggtgcaggcttcagcttcacgccacatcctctctctcttttcagtctctgagtgacttgactcagccagggagaggagatacctacacatccgcatgaaggcgcgtgggaggaagccgagaaatgacggatggcgcagggcctactgcagccgcacgtagactagctccttctttacgggcaaaaccccctacttgtctgcagtgggaaaggagtccgttcagggcaagctctgatcgctgagctatggatgaagaagtgggcagagcaggttccttcctcaccagcgtcacctgcttttctcttccaagttcaaactcggcttaggtccccgcctagggaaaaggacatcagattccaggactggcctgctgtaccaggcggagagcacgagaaaccttcctgctgtatggtgttttggcatagatattctggatgtgacttgagactgcttgctgtttccggaccatttacacccattgttgtcttgtgagcccagtcacggcctgacacggaacgcctctcatgtaatcttctcataggaatctaactaatgcagagtgctgtggcattgtcagccctcatcttacacactgctcaggatgcaaaggtggctagtatagtaacatctgcctctttagcaagagcctcagttgctccaatttaaatacggggagggagctgggtgcagtggcttatgcctgtaatcccagcgttttgggagccaaggcaggaagatcgcttgagccaaggagttcaagaccagcctgggcaaattagcaagacctcctctctacgaaatttttttagaaaacttagacaggaggccaggcccagtggctcatgcctgtaatctcagcactttgggaggccaagggggacggatcacttgaggtcaggagttcgagatcagcctagccatgatggtgaaaccccttctctaccaaaaaaatacaattacaggcacgtggtggcgcatgcctgtaatcccagctactcaggaggctggggtgggagtatcacttgaacctggga

SEQ ID NO: 870 - DNA, 12880 bp, Homo sapiens
agtcgcgcctgccacatctacctccccagccatcctactctctatgctgctgcaaactagacattccttcctggagggacctctcgcttcccatcttcagatcaggacgcacggtctcttctccgcagctgcttcctctggtgttcctgtgctcctgtcggcccgctgctcccacacacatgcccattcttctcgggctggcttgtatctcagggttacgctccccaggtcccttgctccaggaggatggcaccgggtcagagtgttcagacttgttgacgtccctccccccactcaattcgtcactgagccagaagactgagccttgggaatgtctctgagcccaccccacctctcctctctggcagcagccttgggcgagtcctgccctggtcaaccccagcagcctcccaccaaggccagcccagcagcccaccctcccacggctgctcaagcccaccaggccatgctttagacgaggctctgtaactttgcaaatcaagcatgcaccgtaggaccagcctttccactctgctcccaagctgccttccagccctgtgccatcctctacacacccctccccccgctgtacaccccacaccccattaccaggctaccagtcacttcccaaacacaccctgcacactggtctgctcgctgtctgctttgccttgtcagtttttgtaccacctatatctatgcagccagtcccctggattaaattccctctgtttgcaatactagtgggcttcctgttgtgctggacccctggtgatatatttccttctaggaggatggcagcaggtcctctgcctgctcgttcatgctgttccctctgcctgaactgcctccccctcttttttttttctgagatgaagtctccctctgttgcccaggttggagtgcagtggcttgatctcagctccctgcaacctctgcatcccaggttcaagcaattctcttgcctcagcctctgagtaactgggattacaggtgcccaccactatgctcaactaatttttgtatttttagtagagatggggtttcaccatgttggcccagctggtttcaaactcctgacctcaattgatccgcccacctcagcctcccaaggtgctgggattacaggtgtgagccaccatgcccagttggccctctcttttttactagtaaaaagtctattgattcttttgattctttaagacctacagcaattgctgcgtcctctaggatgaaacacatcactacccattctgctttccttggccgtctgtccctgcctctgtgagggcccttctcacaggcgatgtgaatgtctccaggactgggaccctgtctcagccctcgtgtacccagattcctagcaccgaggccagccctcacacaggaactcaggaaatgttgactggagtggaaagtgcaccttgaaatcacctcacccccgaccccagtcccttggagacggggcgtgctcccaggctccttttctgtttgaacagccaaccagagaatgaggggcctcccctgtcctaaccccagggctgtgcatttctgtgacattctcaatgatcctggttaatgtttaattccagtttctttgttttctgtaaagttgataacagagtggtgtagcagagaatgtaaaagaccaagacccacagcaggaaaacaaatacgcaccccgtttttacttaataattaaaagttagtcatttcccagagctttttgggaatgaatggaaatgaattcagaatgttaaaatccagccctgcaaaatgctataaccatataaagagcattcatgatgcttgcatcacaggccccagggctggttttgcacaccagccatgtgctggcctctacaaagattctgtcttcctgaaacttccatcagtgtctgactcctgcatcacaacacagatggcttttctgcgggatcctggataaagcctgagctcatcaaccttaacttcaacaccctccctcctggcccttttcaaccttttcaaccttggctgtctccgtgggaaccctcttttccagccagacatcctgtttacagatctcagatgggccatggggcgggtctcactcctgccctctttgaggacagggtaaaggagtggttaggagtatgaggtccaaattcgggcaggccagggttcatgtccaagctccatcatatctaggctgggatagccacaccacctccaggaagcctgctctggttttcctgacccatggccatgcatttctccagtgtctgcctgctccaagtgtcatcactgcctccgtggcattgaaacctcgtcagtcttgtgatatctatttctctgtcccttattcatgtgtttgtctagtttctccatctggactctaaatgctgtgcccacaacaggctattatgggtctctgtgtgtcccagactgcccgcatgaataatggctgatatggcttggatttttgtcctctccaaatctcatgttgcaatgtgattcccagtgttggaagtggggcctgctgggaggtgagtggatcatgggggaagatcccttaagagtaggttagcaccatcctcttggtgatatgagttcttgctcagttagttcatgtgagatctcgttgtttaagcatctgggacctcccctttctctctctcttgctcccactctcaccatgtgatgtgcctgctcccctttcttcttccaccatgagtggaagcttcctgaggtctttagcagaaccagatgctggcaccatgcttcttttacagcctgcagaattgtgacccaattaaacctcttttctttataaatttcccagtctcaggcatttttaatagcaatgcacaaacggactaacacagaaaattggtatagtgaatagagtatcgccataaaaatacctaaagatgtggaactgagtaacgggcagagggtggaagagactggagagctcagaagaagacaggaagatgagggaacgtctggaacatctatggttgtgacaaaaatgctgatagagatatggacagtgaagtccaagctgacaaagtctcagatggaaatgagaaagttattgggagctgaagcaaagatcacctgtgttattccctagcaaagagcctggatggattgtgttcatgtcctaggggtttgtggaaggttgaacttatttggtggcagctggcagaagaaatttctaagtatcaagaagtgacgtggctgcttctaacagcctacgatcagatatgggtgtaaagaaatgacttaaagttggaacttatacatgaaaggaagcagggcataaaagttcgtagcctagccatgcagcagggaaagaagaagcattttcaggagcggaatccaagcagccagtgtagcaatcatttgctagagacattagcatgactaaaagggagccaaatgctaatatccaatacaatggggaaaagttctcaaaggcatttcagaggtcttggagatagctcttcccatctcatgctcaggggcctaggaggaaagaatgggttcaggggccaggtatggggcactgttgtccagttcagcctcaggacactgcttgccacatctctgctggctcaaaagaccccaggcccaggtacagctccagttgctgctttggagaacgcaagctgccataagccttggcagtttccacttggtgttaagcctgcaggcacacagaatgtaagtgtgaaggaggcttggcaacttccacctaaatttcagaggatgaatcagcaagcctaaggtggctgcccaggcagaagcctgctgcaggggtggagcccccaccagagaaactctactagggcagtgtggaggggaaatgggggttggatcccccacacagaccccccaccaggacactgcctagtggagctgtgggaaggtggctgatgtcctccagaccccagaatgatagagccactgacagcttgcatactgagcatggaaaagccacaggcactcaactccaacccatgagagcagccacagggctagacccagaaaagccacaggggcagtgctgctcaaggccttgggggcccatcccttgaaccagtgcacccaggatgcaggacatgggatcaaggatcattttggagctttaaggtttaatgactgccccaatgggtttcagacttgggtgggtctggtagccccttcctttgggtcaatttctcccttttagaatgggaatatctacccaatgcctgtgccaccattgtatcttggaagtaaataacttgttttgattttacaggcatataggtggaaggaacatgccttgggtctcagatgagacttggacttttggattaattctggaacaagttaagacttagggggactattgcaaaggcatgattgtattttgaaatgtgaaaaagacatgatatttgggtcctgggcggggaataacgtggtttggatatttgtccccttcgattatcatgttgaaaggtgattcccattttgggggtggggcctggtaggaggtgagtggatcatgggggaaggcccctcgtgaatggttaagcacaccccttggtgataagtgagttcttggtcagttagttcatgtgagatctggttgtttaaaagagtctgggacctcccccaaccccttgctcctactcttgccatgtgatgtgcctgctccccttttgccttccacctttcaccatgagtggaagcttcccaaggttcttaccaggaccagatgctgacgccatgcttcttgaacagtctgcagaattgtgagccaattaaaccttgtttccttataaattaccagcctcaggcatttccttatagcaatgcacaaatatactaacacaatggccatagacagcgcttaccattagctcatttaacttgtctacgagggcagcacaacttggggtccacatactcatgcccaacttcattggccattcaactccagccaagtaacaggacgaaaagacagaaacccaccataagctgcggctgaaggtggccatccagcccactgttgggacagaatgcttagtgtgtacagatttgcttcggtgtccctaagataggcttctgacctgtctattttccctgagaattcagaataatcatgaacaagatgggagtatgaatctcagcatggaggcccagtggctgacacctagctttcaaacctaaacatcttgcacaggtttccttgtaccatgttctctgatgcgatgtcctgtgtctctgctcactgcttcagtgccctcccaagcagccgggatggagcccgggccgccacagcccccctggagtgcgtgccgcctgataggtggatcaagagcagaactcacatgctgcctcctggggaggaagggggttgtttatgaccatatgagctttgaggtacccaggatgacaggccaccctagaacccagggagcttgggcaagttcatccccttctctgggcctcagtttccctcatctgtcctgcaaaagaattggatcagataatctgggacattctatccagctctctgatccagagatcaggtttggggccgggtgggggatgtgaagtggtcttccaagctgtcaacatagcctgattgtgtaaggcctgcacaaatggtgtttagagcaatactttcaaaccttaatgttgggtgaatcacctgcgtctagagaaaatgaagattctagcaggagagagtggaagagtggttaccagaggctgggagcagggttggatggggaaagattggtcaacaagtacaaagttgcagcgaggaggaagttcttgtgttctatggcacagcaaggtgactgtggttaacagtaccgtattgtacattgcaaagtaggtagaaaagatttacaatttctttagcaaagatgagatgatggataggctaaataccttgatttgatttttacacaatgcatacatgtatcaaaacatcacattgtaccccagaaatacgtacaattatgggtcaataaaaagcaaaataaaatatgtagattctctctcaatggttctgaggcggggtctctaaacctgcatttctaacaagctccctggtgatcccgcggtgccggctgagtcggtgccttgattaggagggtttggcactaggtctccaggtgtgatcccggagcggcagcatcggcatcacctgggaaccttgtaagagcgagtagggccaagctacagaagtattgggtcagaaactctggggtagcgcccagcaatatgtgatgtaacaagccctccaggcgactcccatgagctcaattctgagaaccactgctttaagacaacagcttctaaactgggcggtgcataggaagcaccgagagagtttttaaaaatactggggcctggggcccgcttgtcggggttctaatgtaatcggaataggtgcctcccgggcatcgggatttttacagtctccccaagtgattctaatgtgaagtcaatgagccttagggcggacagaagatgagggctgcggggctcccaggctgcgagcctgcgattcttctgacggcgctttccggacgacggccactagggcgcgctgtggcaccgctgggaggccggctgcggttcagcctcctctcgccagcggctggaggagctccgggctgggaggcggcgcgaagccccgggggtcggagcctccgggagcggcttctggcccaggccggcccgcccccgtgcatcggcacctaattaatgctggccgcggcctcgccgcgcttgacgtcagtgatgtgctccgtgctggggagacgcggcctttgcagccgctcggcacaggttgcttcaccctggccagccctgctgcccgccccctccaggcagaacgccgggctcacctctgggaccgagcccttgctcatgctgctctgatgacactcacgcgagagtttctcccccatttccacccggcaggacaccagtttccttttccatcttccctggctgttctctgcccctcccctgccttttcagaacacggagggtcccggaaaatcccacaggcctggggctttgccaagtcagccgcaagaaccacctctcacctttccctttctgggtctctcctctgctcagttcctttcctgttcctgctcctcctttttctctcatctgagccgtgtggatcagatacttcctgcctatgcgttctcatgcacagaagtggaagagatgggatggtgaaggggggattgccttctttagcagcacagataggactgcgtttgtaaggagcgttttgtatgttgggggtgacgaggttgctgatgaaactctagtgttctgtcccccacagccacattactccctttaagcagcgatgggagttgattctggagaggagaactcagccgagtagagcaacgctgtcttgtctagctgccccagctggctggaagggtcttccatggctggaggagtttccccaaccaggacgccagaactgtctttttttttttttttttttttttgagacagggtcttgctctgtcacccaggctggaagtgcagtggcgtgaccgcagctcactgcatccttgacctcccaggctcaagcgattgtcccacctcagcctcctgagaggctggaattacaggcatgcgccaccacgcccagctaatttttttttattttttgtagagacggagtcccactgtgtagcccaggctggtctcaagcaatcctcctgctttggcttcccaaaatgctgggattacaggtgtgaaccaccccgtgcctggcccagagctgtctttatcataaatgttccacgccatatttcatctctgcccatccccttatccccattcccaaacctccaatctgatatttgtgtgagatttcatttggaggaaggccatgtacataatggtttggatgatgcctgatagcctccctggctttgccagcccataattctaagatgggaagagatgttgctggggagaagaggcggaggcttctcttctgattcctgcctggagccctgactgcaagggttgctcctggcttcccccatttgaaccccacccctggctggccagtgaggggagcattccctacagccccagggagggagaggctgccagcggccagacagggcattgggcagatggcacagagccagcccagccaggtggggaaattgagacccagagagggtaagggacttgctcaaggtcacacaaccagaccctggcagatccctttccacgctaattcctcagaagctcctgctggggtctctagtgggatactttggacagccctgtgggagtggcggctgggttccaccgggagtggggttactttgaagaacagtagtctctccttgaatccagatgagcagatacggttccagggctcagcctgaccctgaggctgtcacagctggggcaggggctgagggtggaaactgcctctaagagctcagagggcgtttagcctgccaggcacagagcctccaccggggacagaaagccaggaaaaaggtgtgggacgtcagtacgaatcctgctccttccatcgtagactctgaaagtaaaggtccaagctttgaattggatctcagctggggctgggggctggccaagaagattggggtggccacacatttgggcaagtttccctactgcctccgcaatgcgcctggccagggcccaactggaaatcagagacccatgaaacatcagctcagggagcatcagggatgcatgctcgtgcttcaagaggaagaaaccccgagaggaggctgggagagagactggtccaaggtcactggacagtgagtggtggagctggagcttggacgtgggctctggactctggattgtgtgtccccgccactgtcctgacatccatgtggacagatgccctgatccccctctgcaggggctgttctcttttcctctctttggggtgtataatgtgtttgtctttgtgtgtgtgtgtgtgtgtgtgtgtgtgtgtgtgtgtgtacattttttattttgtctctttacctccaaatcctatctgcttcataaaactcagagaaaaagtctataagctcagtcacccattccaggatcgctgtcaggaaatcctcgttcccatctcacccgcatcccccacgctggagcttaagtccttccaggtggggctggcaagagtctgcgggacttactccaagagccccggggaagcgggctgggctgtttggggaggaatgctcacccggcagtgtgcaggcctggcagggctgcctctaaacccaaattgcagtccccaagcacgtgcgcttgctctgcctgagatctccaatgatgctgctttggcgggagtactgattctagccagtgatttatcatctgtttactcagagaaactgcttgttcatttctgctggtgggaagggaaggagggagggagggaggtgaacgtgtgtcctgtgagctgcagaggtagccggcagggatgacttatacactcccctcgatgggtgacctccattcactcttcctccccgcctctccgcctgatgagaaacagaatgtgctccctcccccctgggaggcttcagattcattttctgctcagacaccgttgcttgcaaaattccacccagaagataagggagggagtatcgctgcagcgtcctgctctgtgcctggttatattactggatccttgtgttgcagccctaagatagaaggattgtctccatttcacagatgagagagaactgatgcgcaggaggctgaaattgtctgaagtcacacagcaggtgggtagagctgggacccaacccccgtcaggctggtgccaacttcatgctcttggagcagtgtttctccaagtgtgcatctcgaaccacctgcattaattatagttacttcttccttcagtctctgttgttttcaacagggagttactgacctaggcatggctccaggctcatgggattcagcaatgaggaagacaggtcctggccaaaggaggccaagaacaaacaagtataagcaataagtcagccgggtgctgtggctcatgcttgtaatcccaacactttgggagtctgaggtggaaggatcacttgagcccaggagttcgagaccagcctgggcaacatggtgaaaccacatctctaccaaaatatacaaaaattagctgagtgtggtggtgcacctgtagccccaactgcttgagagcctgaggtaggaggattgtcttagcccaggaggttgacactgcagtgagccgtaattgtgccactgcactccagcctgggcgacagagagagaccctgtctcaaaaaaaaaaaaattaaaaagaaacaagtcaatatctaacaggtgagagcactagggggaaaaggagagcagggtgaggtgctggggagtgacgaggttgtatgtgtgttgcaattttagatagagtggtcaggataaaccttacacaggtgacatttggactgagacttcaaagaggttaagtgttttgctattgaacctgtatttcctgcacctgcttcagacctcctcattcagaacctggcagggaaatgaggcccaggaatacgtattttaacaaatcctttatccacaccgcaatttggaaatcgctgctgtttaccctggtgcttcttcttctacctaacgggtcaggaaatatgtgttcaaatccaggaatggctttagggattcaagaatgaagctggaatcccgagtcctggtgacgattcccttcatgacttgataattggccaatacttagtaactaaaccaggcaaaatgcacctatgactgtgactgagtctggaaagctctgtgccagggcaggacatggatatgcagtcacagcgtgacacagattactgaagtacaagttggtgtcttgaggagtgcataacttagaaggcttgggttctacgtcaggctcacctgtggtaagcttgggccagtcatttgctttgtggaatttcagcttccaggtttgggaaatggagctgttagacctttccctacttagcttataacactgccactacttctactaccagccaatctatgtatccatccatctatccatgcatccatccatccatccatgcatccatccatgcatccatctatccatccatccatccatccatctatccatccattcttccatgcatgcatccatccatccatccatgcatccatccatccatgcatccatccatccatccatccatgcatgcatccatccatccatctatccatcgatccacgcatccatccatccatcctcaccaccaccatcagtatcctcatttcattttatcagcatttctggcatggcctatattcaaaccaacaaaattccagtccaataaaataatttggacatgcctaacacttactgtaaaggaatttggcctgagaaaataatgaagaaaaactgtatagagagtaattaattctccatacattggatatcaaaatctttaatcttggaagattaaatcttggaagttcttttcaatgaagtccaaaggtgggttcatgccactggcttgggggagccagaaaagtgtcttgtaacttcagttgcggtgaaagctgctgtgaaaggcagcttcagatttcccctgatggcgggcagccctgcctctgtgcccagccctattaactgttggcctcccagttgctgaagccagccaacaacatcccctgccatttgaagtgcttattggaaaagcagatttcatcttggctggagctctgagcagttccttgtgtggggtactccccagggctgtaattgaacacaagaaagcgtcggcctacttttggcattcctgctttcatctcaaagacacatttaaaaatttatatttaaaaaatgtcagggaaaggggccagcatggctcgtgtggccactggtgccagaacacccaacacagccgctccaggagcaaaggctgcggaggatgagacaggagaattaggaccataccgtgtggcagtgctccatgcccagcttccgggagcttgcctgtgtggcctgaacagtgaggtgcttttgaggctgggcctctgtctgatctaggctttgcagagcaggagtttgagggttcagatcaggtccccctcacagcagtccaattgggtgagaattttctaaaagctgggggaagagggtagtccaagacctacttggacactcaccccagggtctgggcagcctggctagcaggagatgcactgtcttcccaagccccacctgttgtgctgctgcggaacgtggttccaagggcttctatctacactggtgactgtgggtgggagaaaaccactgaggaaaaagacctactgctcctctggcaggattctgaaaacagtaggtgtctaacggatgtatgttagcttgctctcacatgtgaaaggattgcagttaagcacaacgcaacctttttctacagctcttagtaagatcttctctaggggccattgtaaagctaaaccacgaagcttcatggagggctgaaataagatagcatacactcagaagcctggtctcttagggaccacccgcttccctgcacagggttactgttgcactgtcagcttgtggcccactatgaccctcttaatcttattcaggaatttttgtttatagggaatcatcattctgtatgcaattggctttccctctgagtgcaggatcctgcacttattttacactaagatcattgatagcttgtgttttctaaaaaagaaaaaaaaattgcatgccttacaacaaagaaaatacattcagtaagattattaaaatagttatcttattttcagg

SEQ ID NO: 871 - DNA, 4906 bp, Homo sapiens
gcggcgctcgcgaaacccgaagacttgcagggtaagaactgaagccaccaaaaggcttactataccacacaacacccaagccttcctttggggcatggggacagtggatctatggctcctcagggtgccaaccaattgaagaaggaagccagctccactcaacagcttctacaaaggaagggccacaggagaggggcttcagtggttccaggcagctgcttcattcacaacagaatggccattttctccagcatggccaactatccctagtctttttgtcatgacagcctagaaggcagaagctagggccaaggcggctgctaaggaattcctactcctactggggcctaatgtcaggctttccttatattgtggagtgggccctggaagatagttagagacccttcctgctgggcaccctgaagaggagcaagaggatctggtgagcaaaatgaagcaaaagtgcagtgctggagctgacagccctgttccctactgcacgcagttggctcagggctgtcccccactttggagcttcttgccactcacgggctaccctgcacacactacttactgcccaggcctgtctgccaccacagtaccctgtgcctgagacctttcctggcctctgctggatcccaggcctagtatcattcctagggactccagaggcaagtccaggctaatatgctctgggaaaacaatgtacaatgtacatgtttgccttttgacgtagataaatgatacctggatcccaggtctggctctggggcaggggagcttcaggcctggctatggcagaacactgaaggaggtactttgggttttcacaacctcttaaatcatctcagagagagagtgaacaacttactttcacatgcacaagctgccgctggctctgtcacaagaagatggactacaagtaataaaatcaagatgaagttctgtgtacatctttccagcttacaagaattgtagaaagttgaagatgaaagggatattaaagagcatctcattctacctcctcattttgcagctgtaagaaccgaggcccagggagggggactggggaagccaccatcacacagctgctccgtggcaggagttgtgctaactttctgtggctgttgccattacacccagcatcttttgacttttgaaaacagcgaaggagaaatcagtcctcccagcatcttcacctcccacgacgtttattgtttccagctgttaaaaattggccctttaaaaatgggtcgtcttgccagtcattgagggtcaccgcggtggggagtgctgatttagagggcggcagaacagggaggtgattggaggcataattgccagtctcctccttggcacctggggatttctgtcattcaagtctcagggtgtgtgccctcagcaaatactaacccacagagtcaattgctaactgcagtcatctgtgcatttgccctctggggatggaaagccataagaaatgccatttcctaatctagttggccttggatgagaagatgtttttgcctaatggaagcctttggagagtgaataatgtgaataatgtgtatttaggacctacagtgctccccaggatgctgtaagggacctggttataaagaaaaaaacctcactgatggtcttggctttgtccttgtctgagttaagtccttttggttggaagtaatcaacttgagctgacgtaagcattaagggacatagaagagtatagcagtatctcatgaagtccaagggcagatggcctcaaggtagcccgagaagctgctaggaacctagacagtccaccttctccagctttcttctctgcttcgtgtctccctctgcaatccactttcttctctgtgagtagctgggcagaggataatccctcaacaactatcacatctacatcttctctcctaaagagattagccaaaggtgagtggctgtcctcagtccaataccagattcctgggagagggaatttggttgtcccagcctgggtcaggtgcacagcttgatccaatcaggtgtgcccaggagagggtgccctgagacaggcacatctggggacactcatcctcatgaatgaccggacagttctccaggaaagaagagagaagagtggaggtcagacatttcaaatgtatattataggcatcaaattagttactgatacagaaaaatggcaatgtctaagtagggggcttgagaaacagttcaaacactgtatagattttgattatttgcttaacttccaggatgataaattgtctattatggagctgtattttttttttggagacagagtcttgctgtttggctggagtgcagtggcgtgatctcggctcaccacaacctccacctccaggttcaagcaattctcctgcctcagcctcccgagtagctgggattacaggtgcccaccaccagccctggctaatttttgtatttttagtagaaacggggtttcaccatgttggccaggctggtctagaactcctgacctcaagtgatccgcccttctcggcctcccaaagtgccaggattacaggcgtgagccaccatgcccaggtggagctgaatttttttttttttttttgaggtgggaggatggagtctcgctttttcgcccaggctggagtgcaatggcacgatcttggctcactgcaacctccgcctcccaggtccaagcaattcttctgcctcagcctccccagtagctgggattacaggcatgtgccaccacacccgggtaatttttgtatttttagtagagacaaggtttcaccatgttggccaggctggtctcgaactcctgacctcaagtgatccacccatcgcagcctcccaaagtgctaggattacaggcatgagccaccgcgcccagccaatctttttatatagtagatttcttgcaatgtaacccctatcctctgggctttgtgtaaaaagtgcattcagacaatctgaggagtgtcttaattttttgtgtgactatcatatatattttcatcctgttgaggtgtgtttgctaggtggatattgaacatgaaatcaaagtataattttaaacttgtgttgaaatatatgtgtataagcatatgtgcacaattacctatattgtcaaacacccaacctgctttccaaaggatttgaagcaaggtctaataaaaacacagaaaaagtatggccaagagctgtaaacaccaaaaaaagaagtaaagggcaagtcgcaaacagactgcagttgagcaaagctgcaaaggactataataccaggcctgaagtggttgctaaatgtagctctgagctttctgacattcaaagccaaaaataggtatattttattatttaaacagtgtctactctgaggtcctcaaaactctttcagggggcccacagatcaaaactattttcataataacaccaagacattgtttgcatctttcattgtcattctcttaggagtgtacagtggagttttccagaaggcatatgccatgtgcatcaccacagcttaaatgcagaaacagacatgaggatctagctgtgtcctactaagccagacattcaggacatctaaaagtgtaaaacaatgccactcttctcactaacttttttgttttggaaaatatatctttcataaaatattgattatgttgatatattacgggtttgttgttattattttaaatgaattaataaataattttctgatttaatttctattactgtaaatattgatggatatatcctgtataagcaaaaactctctggggttctcaactatttttaagagtgtaaaggggtcattagagaactgctcaagaatgttagtattatttaaagagcttctgcacagaaaaactatcaacagagtaaacaaacaaactacagaatgggagaaaatcttcacaagctgtgcatctgacaggggctaacatccagactctatagggaacttaaacatttcaatgagtaaacaataattaaccccattaaaaagtgggcaaaggacatgaacagacacttctcaaaagaagacatacaagcagccaacagacatgaaaaaatgttccacatcactactcagagaaatgcaaatttaaaccacagggagataccatctcactctagtcagaatggctattattaaaaagtcaaaaaaataataacagatgctgttgaggctgtagagaaaatgtaatgcttatacattgttgatgggaacataaattagtccagccactgtggaaagcagtttggagatgcctcagagaacttagaactaccatttgacccagcagtcccattacttggtacatacccaaaagaaaacaaatgtttccaccaaaaagacgcgtgtgctcatatgttcactgcagcactattcacaatagcaaagacatggaatcaatctaggggtccatcagtggtgggttagataaagaccatgtggtacacatacaccatgaaatactgcccagccataaaaaagaacgaaatcatgtcctttgcagcaacatggatgcagctggaagctgttagcccaagtgaattaatgcaggaacagaaaaccaaatcctgcattttctcacttataagtgtgagctaaacattgagtacacgtggacgtaaagatggaaacagcagacactggagactaccagaggaagaagaaagggagggaggagaaagggagggaggaaaaagggagggagtcaagggctgaaaaactacctattaggtactatgctcagaacctcagtgatgggattaattgaacctcaaacctcagtgtcacacaatatactcatgtaacaagcctgcatatgtgccctctgaatctaaaataaaagttgaaattattttttaaaaaaagaatattactattatttaatca

SEQ ID NO: 872 - DNA, 1480 bp, Homo sapiens
ggtcctttcattttataaattagacctgatattccctgtgttcttcaaaatgaaacttaccataattggagacatttttcctaaaatgcatttgaaatggctttatttttttgcatgccacaaaaataccagatttccttgtcagttatatgttattcttgtcatgaagtctcatcagaccttctaatttgaaagttatcagtaattgatttaatcacagccatattaagtctctgtcacctacagataagttttgttttactctcaggcttccatggaagttctgcaatcaaccagcaggagaaccgcttaaacccaggaggcggaggttgcagtgagccaagtatgcatcactgcactccagcctggaagacagagtgagaccctgtctcaacaaaataaattaaaataaaaaataatatatttttctaactatcatcccttttccaaatcaggaattccccttaagttttcctcaatttccatggcaatatctttgcatagattcattaagaatttgtcctttttaaataaaaaatataaagggaactattcattaggcaacaaatgccttgtctgaaatatcacatttgagaatgctgctcatttaatcagaaaggtacgctactttaaagaactgaggtccactttctggagccaaaaactcataaatccctctcagaaaaacctgatttgctttgtagggtctcaggtttagagatgctgaaaaagatattttcgttgcagacaaaggacctcagagtatttggagaactttgagaagagaggaattctcccaaatgtataggtgtcacaggtaaaatacagtcgagagattttcttggactttaattccttaaatcaggatagcaaataataggggcttttacaaattcaatctgtttccttacaaaaattttcagcaaagtaatttcagcaaattaattttcagcaaagtaaatgtaagaagacttatgtgaaaaattaacattctccatgtatctatgaagccaaacctaataaaaccagctttaatttgtgctcaagaatattatttcactgagttttcttaaatcacaaaggggagactgttatgaaaactgatataaaataaaaaaaacaaggaagaaaagtctactagatgtctctaatggaagactgcatttttagaacatatccttataggcgattctagcctttctctgctatttggctctcacactctttaccgtgcagataattcacagcaatgcaaaagaatcctcatctatagccatgaaaataagttatttgttatttctggtaaaggttcaattgacctccccttccaggatgaagaaagtttcatgtctttctgcatcatttcaactattccttactacatataaatctgcacttgttaacttctattttgaattgattgtggcatctgcctgcttccccattaaaactgaataaaatctttaacacataaaaatgt

SEQ ID NO: 873 - DNA, 6936 bp, Homo sapiens
actctcactatgcccccgtaacagagtcagtttttaggcggagggtgagaatggcttgaaaatttgctgaatgctatccatctcccagcccccagagaaaagggctttagttcctccccctgcctgtgaagtctgcaggccagattcgcgccctcccctgagttctggccaggaggcttcttgccctgttcaaatggttacaaagttcagctagagaattccttctccctgtagagttttaccccctgctcctctggccgccctccggatggatctttgtgttgccaggcaggaatgggctgcttggggacccagtgagctccgagggcctttctgctgcttcctgtacccctgtatttcgctcagctctctgacttgactcagctccagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaatcagacctattaattctgagaggaaggaggtgtcaggattttcacagaagaagagcactaaggccaggcgcagtggctcatgcctgtaatcccagcactttgggaggctgaggcaggcggatcaggaggtcaggagttctagaccagccagacaaacatggtgaaaccccgtctctactaaaaatacaaaaattacacgcctgtaatcccagctactcaggaggctgaggcagaagaatcgcttaaacccgggaggcggaggttgcagtgagctgagatcgcgcgactgcactccagcttgggcgacagagcaagactccatcaaaaaaaaaaaaaaaaaaaaaaaagcaaagcactaaatctcgtatgtgaaagatgagtagatttttcctaacaggagcaataaaaattagagctaaaaataatttcatgaagcaaaatattcaaagaagatgaagaatgaataaagacaattgatctggtaattcacaagccaagcttcagtaagtggtaggatagacgctgatttttaagtgtaaaatgagcaaattatgctgaataaagaaaattatttaaaaattgtcaagaaataactagagacccagggaagacaattttcattttaaggcttaataatgtttgcagactgaaggaaaagatgcagtggaggatgagagaccttagcaggggattaaaatagtggagcatttttgtggcaatgccattcaataagaagacagcattggaaagaagagagacatttattcctcctaggtaggaagcaaaaagtagaaatttgtaaagaaaaaagtattgggagataaagaagaatcacaggtgtaatcctgaacatcctaaatcaaaattattgtttatgtatttctccttccagaaatgaaacttgtaatagacgatctgtggcttaataaccttctatctccagcacctgacgtatggcaggtctctcaatatataattaagatatggatctatggaggtacaataattcttgttatatgaatcactattcctgaagttggagtatattggctcatctgggaatagggaaattggcagttagttgagagaccattggaacacctgctgaaagaaacgtgataatgattcaaggggaggaaaaaaaaaaaaaagaaaaccaagtgaggaatgaccacaataacactaacttgaagtggatgcagtcggcatatttttgaaaatgttttaaatcaacaacttctatttggagagcagatgtaattacaccagacagcagagataataaataaatatcagtgcagtcacagtggtgtggccggagtatcagtgcctcggttgctatgggcagcagaagacacagatgcctctggcatcctagctggcaatgaagaaaaataaacacagaattaggcttcaggttagagaataacagaataatagaggttaggatttagacagaaaaaaacaggcttgctggagttatggaagtgggagagacgaaacaagtgaaaaagaacttctcttcttgtaatttctcatgttcaaggaaaggaaatgtcagcattcaaaattgcagagaatgagaaaacaaatgtgatgattttgatcaaggtcatgtttatgccggtgattaacagataaaatgaagagtccttggcatcataggagggactctgagccagagtgctaaaaggaccatctacttaaatgatggagttcataataagattggagtggagaaaaattatgaagcaagtactcagaaaatgagaatgttaggaggttacaggttgatggctttaaggatggagagaatatacgttatgataaacataaaaaagtggatggtggaacaaaagttgcctgaaattggcagctgtgagtaattaatctttaacatctcttccttacttaagtagaaaaagggcctccatcaaaatggtagtgagaattttatccatcagagacaacacactttcagttgcagatgagacatggaaaatattctcacacaaaatgtggtcaagaaaaggagtaatagtacttatttttctaattgaatacataataatattaatatacattatctgtaaatattcatattgatcatgggagaggtaatcagaatatataatattgacagctgaattgaaattaatatatttttctaaaaaaatgagattatgggtaatgaaccaatattggctaggtgaaaattgtctagtttttacaactagaaatgcttcctctcaaacacttatcaaaatcacaggtgtattttaggctgctatatttgccaaatgaaaacaggatactgacattcatacacacaaacatgcaagcatatgctgaaattttcattccagatgtctacaaaagagaacagataatacgaagttcgttacctatttcaagttacctctgagattccttacgctgaagacaaatattctattaaaaaagagtccttaaataggccataagaacccgaatcctttcataaagagtgaaagagtatggttatttttgataacaattattatcaaaataaattatttttacttctaaattagtactgattacatctgaaggtttttgtttctctgataccaggatttaaaattatttcagaaagcatgattagttttagtgtctgtagatctttgctgtcagtgaattaaagtatttttgaaaaaggaatatgtattcctgaaaagtgatctatactttatagaaaattacctatttgtgtaaatataggaaaacagctctaacattaaaatatgtgcatcaattggattcagagtgttgcatgaggtttcaactttaaagaagtatttataacatttggagaaacaaaattaacaagaaaaagtaaaaccaaaatattaaaaataaaggtaatattcctcatcagaaaataagaaaaaaataccaacaattgtggtaataccaaagtgattttaaaaatacattttttttttttgttcattggttgtcttgttcaattcagtcaaacataagccaacaagataagactccacatagatctttttaagttaccaagtgttgtgtgtgccgctctaactgtccatggtttctgttttttctactaaaattctagcatactaaattctgtatggtattttttctagcattatctctggaaaattagaccagtgactaatacaattactcttttagttttcatagatttgactatatgtctgagcctggagttgtttgcgtttattctatttcggagtcactcagtttcctgagtctatagattagtttttcaccaaatttgggaagttttcagtcattatttcctcaagtaattgttaagccccatatcctttttcctctcattctaggactgcagtgacacaaacattaactatgtcattattgctccagaagtctttgaggctcagtttttttttttcttatctgttttctctcgttgtttagattgggtaatctctactaatctaccttaaatcttactgatcctttcctctgtcatttccattttgtgattttgtccatatgctgagattgctatttggaatatttttacagtaccttgtttaacattcttgctcaataattttaacatttgtatcatcttagtgttatagtctattgattgtcgtttcttacttgatttgagattctcctagtccttagtatgtcaagtgactttggactataatttggacactacatgtattatgacgtaagactaaagttattacttcgatcttttacttaagtgggtattccacctgtttagtttcaaaatacatgtcctagctcacttttgttagctattgttcaaatttcaatttggtttctaaatcccctggagtccagtatcccccagtcacagttgtatgtgactcaggtgacaggactctgccccacaatcttctcatcatggactggggagacagaggaaaattacttcactgccacagaggatggtggaattcagagttccaggcacatgtccatagggaaatggcacttacacattaaaactggtcagaaatgaatggcagagtgacacccacaggcttcagtagatagcggtgcctcctgatactgggatggggtggagaacaggcttacgccccatatctctgcagggatggtgagactgcctgaataccatggaagagggagatggaagtctgagctgtgcacataagctccactggggagaggtacaacccagttactgcagaagaagggagaaagtcagaggggtcatagtctctacggggaaggaaggccatctcattcctgcagaaggtgggtagatgtgagttccacccacaacctccatggtggggggatgctacctccttactccaggaagagggtggaagacagggttctatccccagtcccacagttatagcactcattgaggtggagatagaacacattttttttcatagtattcctcttgaagaaagataagtatggttaaaatatttctgctatgctgggttaccctttttcctggtactttcactagagacagatgatacagaagagaaagggtgggagggggggagagatatagaccacaaagaaaaatagaaaggtgaataattcctgataatattagatgaggttatttattaagacctactttacacatttactacaaggtataattgacaaaaggtaaagatcatttgtaatgagaaactttctgccgcttgtataatacagtgtctgtactttcaccaatagcttctctatttaacattatgtggttctaaataatctttcaaaacacatactaacctgtttctctgtaatatcatctcacagacagatttaaggataagttaagtgttttaaaaatctatttatattaaattatataagaatggaggcaggaagacagagcttggaacattatctacaattagtgtcttatattgccatggtcagaatgtttgtgtcctcccccaaatgtatatgttgaaacctaattcctaaatttgatggggtttagggaagtgatttggttataaaggtagcaactgtcatgaatggaattagtgcctttatatggggctgaagataccagagttcttcccttctactctgtcaggagatagcaacaagctggctatctgcaacccagaagaaggccttcaccaaaactcaaccatgctggcattctaatctagaacttccagcctccagagctgtgacaaataaatttctattatttataggtcatccagtctatggcattttgttataacagtccaaactgactaaaacaaccacaaaggcagaaaatgctagttttctactaaatggtcataaagaattgaataagtgatcaaaaaaacatgagacagctgtctgtaaatttctgtacccccttcctccatcgtaataaaaatttttagctctacatacagatacaggaaataaaaaatactttccaaatttgcacctgggcatagccaagcaactaacacttgcattaggatgtgggtaatgggtatgcatctgcattccgggagatgccctttgataaggtgtgccatcctttttttctcttcctcttctcacttgttcatattgaacactgaaggggcagtatagcatcttgggaagcagcagagttaccatatagacaagtagagaaaacttttgactttgcagagtggggctgtgttgactgcttgacattttacaaaagagaaaaaatgaacttctatcatgttaattctactcacatttgggattgtctcgtgcttaaactcatagccgaactaatacagaaaggaagagagcatgaagaagtataacatttc

SEQ ID NO: 874 - DNA, 16942 bp, Homo sapiens
atgcactattaccactgagcatttactatgttccaggccctgtgctaagcgcattgcctgctgcgtctcacccttcagtaggagtagttacctccaactcccgccagacccaattcagagctgccatcaggtcagacctttgcctgctcttggcaacacgtccccctgtcctgctcctctgcaacctgcccctctttttcttcatgtgctgtgaaggcaccatgtggatgggtgttcaacttctggattggggatgcacagagcctgagggacacactttgcaaacctgcaccttgcacttttgggttctggcctgcaaggtctcctttattcttttggaccaaggctgtccctgggagagggcagccgccggcctgtcagagcaaatcagcctcaggcggtttctgcggctctggtatttgagctttgttttccctctctcccgggaagaactcattgaaatagtttctctgggaaagacaaagcgtctcgcccagatgctgaaggatcacttggtaactgcctgtcttggtttcccgttgtgcccatgaaggcgccatcagctctaaagctgacctgtggttccgtctccaaacagctaacccagacgtcacccccttgcagccagccgcacagcctgagttggagttctggcctctcctagcagtgagtgacagtgttggaggggccttggacaccttgggtaattgctaactaaatatgagcagtaggggaaggtcttctggtccacggcagagccaacggggcacttcctcttctcttttctagtcagggtagaaagctagaaagaatcctaaaaatcactatccaagtccccattgtgtggggacagaggcctggcctgaagcctaggctggagggttcagtcggaagcagaagccgggagactgcatgagagggttccttccagcttcaccaagcccgtgctgcgcgggatgaagaaagtcaagcctgtcttccagtggggccctgaggtgggggagctggaggatagggtggcagcttttttatcagctgtccccaaaagaggcccttctcccagttgccacggaccaaagctcctcctgggagctccagcctgtctgttcaatgtttgccttgcgccttttcctggtgaggccacccccggcaccatctcaggcctcagaaggacgacctcactgaaacagcccttaggttgggaaagaagcaagccctccgcgccccgtccaagtctctcaactgggcacgagcacacacagacgcccaggccctgtccctgcgccagaatggccgctcgcgtttccaggcacgatgcccctttccatgagtgcacagagccctgggctgagctgggggccgagctccacgctctctgagcagctctgagcggcacgccaaagaaggtctttcagatgggctctgggatgtggaaccatggcgtccagccctagcgtcgactccacactagaggcaccctgactttcgcccccttcttacctgagtatcagcttacttccatctggggactgaatatggggcagattccagaaaaaggaggttggggcaccaaaaccaacaccaactctgccaacggagccagcacagctatttgtctccaaccacaggccgcaagggaagttcacgggctcggcacccccaggtcccggatgtaaggatattgcccgttagacaaaggaaaggccccaagtccacaactcatgtttgtgagcttaaccttgtcctataaagcactttggaacaggcccaggttctcccaccatgtacagctgccattgacctggacagtcccgcaaggtccttcagtggaaacccagaagggagagtcactgcatgtgaaccctaagggttctggaggtcaaagttgctgtgggtgacaggcaaccaagactaagggcaaacttgaaacataaatgagttaaaacccacaaaaataagacagttttaaataactaaactgttttctcattcttcctttttcatctgaggacgttttaggcaaatgaagctttagagtttttctcctttcattgggttgacagtgtttaaaattatatccagagctgtctaatttgcctattgctctaggcatactgatcctcaggaggtaagattggatgggttaaagtggacaggctcaggggctgagactgtccatctctctgagagtcgggggcagcatttatcaggggcctgtggtcagccaagcttggcttgggctctgtgggaagataaaaccaactggcccagatggacttctgtggggcctggatactgttgggaagataaagcacataagcccggtaagaaaaaaaaaaaaaaaaaaaaaaaaaagcccaggagaaggaatgcaagtgattccaatgcaattgaattaagtacaaactcactaggaatgggggggggggtttgattggcgaaggggttagtcaggggtggttaaccacagaagattgaggaggtgaactttaagttggacttggaggtagaagagagaagttaggggaagcatttgttttatatttgggtggggtgcgtgggagtgtggataagtgaagtgtcacacacacacacacacacaactttgagtaggaagagggtcaagatgaccaggttggcctagacaagtcagtactagcttaaaaagtcacactcaggattcctgcagcacctcccccatacccacccccaccccaatgggcacagcactccctcttctctccaacgcaggcctcctgtctggggtgctatgatcatttccatagcaaccaattgctctgtgacagagacataattctgactccaggtaggttatgaacagaagaaacatatgaaaccagtaagtgacagagatctagttttccagtaagtgccctgctaataaagaagagaaaatgcacaaactaaaagataaatggaacaggaatgagcaaatgctaaattttctatgaggcatcagctgtttgtttgctaaaaacaatagcaacctaatagtttcaacaagaatggtgctggcaaggacagctcagaacagcctctgtcagtctgcagagtaggggcgatggcagagcccgggtatgcacagtgtcagggttgtgaggcagaaagatgccttaaacgcatcacctcaatcctgcacacatccctagtgcctttattggaaaagctgcactgctgctgctgtgaatccagcatgacctcgccttcattcattcattcacttatacatgcatgcatgcatgcatatattcaagaactcatcagtgctaggtaggttactaattagaaataattgggagaaaagtctgaattactaggtattttagaagcaaagctttcttactctgaaagcatggctgagatggtgccttcagcagggactcagagagtctgatccagtctgggtctgccactcacactctgtataaccttgtgcaagccacttaccagtcttggtcttcatcttgtagatgaggtgattggtgatctatgtgatgcttccagatctgtctagttcagaggcctgctttaagtgtctaaacggttaatgtcagagtgagttgatgtgttcggtattttcatagagcagaaccaagactgtttactcatttaccatttatttccaccttctgttgatattgattgaccacttactatgtgacagtcacagatctaggcatcagaaataaaggtaagacgtgatggtggcttcagggccctcatggccaggttgggggacaggcaggcccaggctcagacccatagggcacaagctggtctccaagtgtggacagagctcatcaggtgtggggaagggcacctccacctgtggtcaagagctctctccacaccctggatggggctggaaggaaaggcaggaggcagactcagagaggaggagctgcatggagagggggtgctgaggaagccccacatgacccaggaatcttgcggggagcggagagtagagagatgcagacaggccatgccaaggcccgtgctctgacatcatggtcatccttctcaaagatctggagattaacagaccacatagaagaaggggcaataagttaaggagaaagaaaataagcagaatcccaggagagaagagcataaggtctgggctttgtgcaggcatatttgcctccaggggagataccagttgctgcctagtgctgtcatcactaaggcctggggtgaggctaagaggtggacacctggggaggagctgggagtgagtgcccagactgggaaaagactaagggaacatactaggctgccagaaagcctggagctttctgaactcacctgaaccttctgagctttgggcagggtgctttagtctgccctaaaaccggcagagggcttaacgcatggtttcagtgcagagcaatgtccatcttctctaaaacacccagaaagatttggtgagtgaattacagactgtggtgctaaggggagtcttagccaaagagacaactacttgcctttgagttttccatgcttgtctacttaacagaatcatgaggactcccatatcctctcctaaaaattaaccagttaattattcaacacgcattttgcagcagctagttggtattattcgttatgctacaaattctcagggctcaacagaggcattgttcatgtccttgaggagtttatagtacagctgggagtttgcgtatgcaagtgaaagtttatatgcactaagttatatctattaagggctaaaccaggagtgcaagcagagaggattacagaggtagaagagagagagcgcgtgtgagactgtacatagtctcttgggacgggctgatcaggaagtcttcatggagaaggtggaatttgtgtgggttttgaggacagctagatggaaagaggtcagaacagagatgtgtttgggagagacaatgctctgcagtagcatttagcagctgctacttgtctgagaggaaacctgggcactagcatggaaagaggacattttctgacattggaaatacacttcaatgtcaacctcgatccaagtttgaatcctgtgtctgccacttagtagcagataggcctgggcaaattccttaacttgccttatctaaattgccccatttatacattgagagtggggataatgttgatctcaaaaagctattgggaggatagaattaatgtgacaacaggtaaaacacttccaggaatacttatcccttctccctttcctggcccatcaggaaagctgcatttaagaccaaaaggaataattattccagaagtcctctgagtgcccttgtagaagtagataaacagattgatcagtgagaaaaaaaatatgttctcatccagcctgtggggtgagttaaccatgcatgcttttctccggatgtttgacttcctgaatctttcctgaacaatgccatctctgtcctggcacccctggcaagcagtcccatgtgagacaggttcttgtcacatgtccttttcctgaaatgagtcactagagagtgggctgtagtcataaccttcaccagttaagggaggtgaatgtggattggaatgaacacaaacacggtactacttggtgcttaatgttcctttccatcaacattttgccccaggccttaaccttgcaactcaaaaaagtagggtcgcataatgaatgggataaactgaatgaccgcttgtaatccacaaacaaagggcctttcaacagcctatggtcggaggccttatctattccaatcaaatctagccagttgcaaactggagaaaaaaatgggtgatcccagtgagaattagtcccagaagaaaattgaaaaagacattttgttacctcctcaggaaaagtgataatgagcagagaagggaaaaatctaaataactgatgcaaagacaaagaactgaaactgagagaattggatgcatgtcttccccctttagttgtataagcataaactggttttatgacggcaagcataaaattaagatcagcagtgcacaaatctctgtgtaaccttcaagaccttttatttccccaaattagaagtgaccttaagaactgatggtgtcttcaccctgggcagctatggtggtggagcagaaaatagtagactgggattgggacaggctaagtcccacccttcaccctggctgggtgaccttgggcatactcacccttgcttttctgggactgagggtcttcatctgagaaatgaatcatttttcttgataatttacagttttctttcaaatccctccacacccccacccccaccaaggtttttatttttatggcaactcagatcttgaaccttaaaaaaaaaaataaagtagagaggacagcaatccttaccagtgtcactctatcaccctatacagctcctcaaacacaagcccagaaggggcttcattttggtggaagtcctgggcctacatttgtatatttaagtggaacccgaatacttgctcccagagtggtgtcagtggtcaccccaactttccaaattctggcaggcacagcaggtcattctgtgagctgttctcattcacatcctatttccaactggttctgttccacggagccccagctgtactctgcaattcagttctaccaacgctcattgcatgttgctgatatggcaggcactaatgtgagatgctgtgagcaagcaagcatagcccagccccactctagtagggaacacagaaatacttgtaatgtgagccgaatggaagcataatgccctgtggcaacacttaggagggtgacggtcattctagcttgggcaaagcttcatgggggaggaggcctttgtcctgagctttgtgagatgggtaggatttaggcaggctgagacaaaggaagagcatgccaagcagaaagaagagcaggaaggaaggcatggaggcagaagtgttcaagtcatatttaaggagtggcacttgctggatctccaagtgtcttcagagtgatgagcttaggaattcagggaaaggccttgtcatagaaagccttcaggattctaaggaatttagactttagggcagaaaatgggaaaccatggacattcttgagcagggatatatcatggtgggacttgtgcctcaggaagagcaatccatcagcagaaaggcttggagagtgagtagaggcagaagaacaatgagggcattattgcaaaagtccagaccagtggtcacggaggtctgaagtttagtgatgagaccaaaattggaaaggagggaactttggacaggtgctgtagcagcaacagaatggaggctctggggcttatggggtatggggattaaattcacactgaggcaggagagtgttgagagggaatccagccatcttctcttcctgggctcacagggtggtttatcctgggggttgttgtgcagcagttctctgatgtcaaaaatgagcaggcttagggaaattgatctactttggtagagattgtgggctgtccaccaatatctagctaccttactttattaaaaatagaatccttaatttttagctaggcaaatgcctcctacccctagttggaataaagacatttttcagttttcttgcatcagaatgggtttgcatgagtacacctgggcagtgatttgtcagactttgggaaaatatgatttttttgttggcaagaaagcagcctggatggagctccagtgaccatcttaaaccactagacaaaaactcatgttgaagataatggagctataagatagtgactgatgatgactgtagagttgccatacttgtcccaggctgccaacatctggatttcattgacatgggagagaaataaatgtacattttatttatgctactgttttgtctgttttatgcaaccaaatctaacctaatctttgtccatataacaaaagtcaaaagagtataatgcaaactcatttataactttttaacaatggaaatatatgtatctcatctaaggacacatcttccaaggattttagcacccaagaagccaaagtattcattcaaagattgaggggtgaccagagtcttggatggggcaagtccatcaggtcagttcttgggctttagtccatcaggctctatagaaacttcaccaactctctttactgcacaaccaagccctccactctcatgagaggggagctcatgtcctctaagccccatgtctctttccactgaaagagcactgctctcagattcccattttccccaattctattcaatttgtgtcttgttaacataatcttcctttaaatcagatgcaatacaactgaggatgactcaggtcttggagttggaatcggatctgagtcctgccctttctatacttgacctcttaactggccagtgactcatttacacaaaatattttgggttggtttggcaagtgttcactgcttagatactttacattcaggatgtactttatcatattaagagtataggggatacattttcttacatactaactgtaggggacaagtacaaatgaatagcccaaaccgaggctgatgttaaaggttagctgccggggaggatggaagaaccagtcttcattccccaaccctgtaaaagacatctagaggtgaaactggttttaccaggaagatgtcaagatcagtttaagcctgctgaagtggaggttctaatcaatatctgataatatctaagatgtattgagcacttgctttctgcctggcaatgttctaagcacttagattcatcaaacgcatcacctcacaactacatgaggcaactactcccaatacccccacttgcagacagggaaactggaagctagagatgaagcaatttgaccagcatcattcagttagcaagtagaagagctgctacttgaatccatgtgtttctcatcgcagagcccttaactattaccttagttgttcttagggagcttaacaaaatttccttcctcacaatctccctcttatcagaatgtatttcttctctatgatgccaattccatacttgatgctttatctgagaaacctttacaaacaggctggtacttgccccttctcaggtgacaacattttaagtttgatagaggttttgcaaaggtgtactgataaatccactggaggaagagttacgggtggagaaaactcttaatctgtagcctttgccaatttccatggtgtaaatactcccaccatgaccagtgcagctggtaaatttcctgaatatttgatgattgcctcctgcccagcagctccagcacaccactgggccgagggttctattatagctaagagtgcccacgctggctgggaattctgggaatccatggccagcctgagagagttctggcatgagagagccttgcagtccccttcaaggcatacctgttaggggggtccccagcttcttttcttcagctatctggcccagggcatgctgggaggtggtgctgtggcccacagagaggctacagacctgggctcatggcccagtctccctcctgaggctccagctccccttctggaagcagcgctgtgaccagcaggtggcagcactctcacgttcaagagtctgtgcctcagcaaaatgaggggcctttgttctgagccagaggctgtgtcaccaagagaaaggccctgaggggccagctaatcagcctgtccttagctgacctccatcaatgtgagccaagtggacagtctctggcagcgtgataccatgagaacaaccttagcaaacagcagagacagcacagtctcaacccacccctgcccatcctgagggcttggcctggggaggcctcataaaaacaggtggggctccattcaggaagggaggtaaatgccaagagtggcgcttccagtgctaaggaggaaaagactcctgcttgctcccaccaccagctatgctgtggtgccgccttccttctctgctgactccatgggtgctcagttcccaccaggtgaccagctgttccagcttgcccaggactgtcctggttttagtactgaaagtctcaggtcctgggaaaccccctgtccccagacagcaggccagctggccatctgaactcccagtccctgtccatgtgcaacgcctgcctagcacacagtaagcactttcgaaggcgttgctgttgcaggagaaggcaaagcagaattcaggtgggactataagagctgactgaccccgatagacaggttggttagttagttaattggtattgattgattgatttaatttatttagaggcagggtctcactctgtcacccaggctagagtgcagtgtcacgatcatggcttgctgtagccttgacctcctgggctcaagagatcctcaaacctcagcctccaagtagctagtaccacaggcacatgccaccatgcctgccaattaaaaaaaaaattttgtagagatggggtctcgctatcttgcccaggctggttttgaactcctgagctcaactgatcctcttaccttggcctccccaaagtgctaggattatgggtgtaagccaacacaccctggcctcattccattggtaaaagctgctccctttgctttcggtcagaggtaggagccagaatgtgtgaggggaaatcctcaaaacagtccgtttcttctccagctcaccttgtatctttgacctccctccctcttccttccctctcatgctcgcccgcctgcctcaacaatctcaccctccccagagtccagaggcagagaactccgtgttccaaggaagggtggagcctcttagagtgggcaggtggcagggctggtaaacaggacaggccagaggaggggttgaggcaggccaggaggcgcttcagccacctagacatggagcagcgggatttaggcagcccaaagaatctgtgcgaggtttcctggagccctccccctcctgcccccacatccaagcagggatgtgcacattcctctttcctcctctagctcaatgtgctgtggcttatctgctcacgtcactgttgacccctccagatggttcacttggactcccagtgcctagcttggggagtcaggcacggcaaacgccaccctgtgctatggcttgaaggaggccagcaagctttgcttaagccaaggcatgtgtgagaaacttgcaaatccttcttccctgctctggacatggggagaaaaggcagacttcttgccatggccctcaggttctgcacagaccggcccttgtcaattctccaggcttatcttgtgctgtgtttcccagcactcagtgtggccatcatcctggccttctgccaggccctgctaatgccatgctcactcctgcctcagagtcttcactcaggctgttctctctgtctggtcaagaatagcaggcagggtctggtttagacatggtcgtccaagaagccactgtgagcaggggaaagtgaagctttgatctggaggatgtgaagggtcatggtgtccacctggggaggaggtctgctctgacaagcacactccctgtggtggcaccagctctctgtcaccctgttaggaaggagttaatgggcatttccaaaggcaaacttctcatgggctttctgttttaaattttctatataactgaccactcctcatatcaaactatcatactcagcgggtttgtattttcattccactggtgacaaattaatgcaggcatagccctattctggataaaaattgaccatctcagtgaaatcctgctgactcctgtctcccagccagcacttggatttggtggagcctgcattaaccccagggtctcaatagagattcttaggtcttggagatttctactaaaaggcccactcttccaccttacagaatataggtcagaagtttgggctacttcagctgccagatcatagtaaataaatattgagtttattgaagaaatactgattttatgacatagagtttgccaagtaagccaaatcctagatacagtgcacagcaactctggttattaagatatagatggaaacccaggctggcaactatagtcccagctactcaggaggctgaggcaggaaaattgcttgaacccaggagttcaagaccagtctgagcaacacagcaagaccccatctctaaaaaacaaaacagttcaaagctttgaggaggtggtgaaagcctttattggtgttaaatactccatctcaagagctatagaaagatcttaactcttccagagaggccatagcctctgtgtaaagcacactgtgtaagctccatgaaggacacccaggaggcacgcatgcccagagaggagcggcacctgctcctcccctaccctggaaagagccaggccatgattcctgtggaaagtgctgcacctcacccagctgtgagcaacctcttcctgggtccttgggggtggggaaaccaaatccctgggtttgagtagtatttggtcttttccaagagcctgtgtctatgtctgcttgctttttgggttagctccagccaatccctgttatctttcacagaggaagaagtatccagctgttggggaaagtcccaggatctggggccccgggccagttacagggatgttgggttatggctgctcttttctttcacctatttgtctagaaatgcaaactattcaggttgcccatagcaaagaggccaaggttgggaagctaaggcatggatgtggtgaaggagagttggaggaaaaggctcaaagaacctctgttggtttttggggggtgtgacttcaatcttgttccttcattcctacgtggccgaagagtccccttgagtgacctcaccttcacccaacccccacccaacctgcttattcacctacactgacacctgcccttcagtaagaagccccaccctccccagaacacaaagttctccctagagtctgggaggaagatctggggtgtgaagggatgaggggagggcagtcagggctggaagtgagaggaagaaagggatggttttattgctcctctctcgtactctggctcctgccagagctaaggtagcaggttttaaaaatgaaatgaaagcagctcttgcttgttagagttggtcatcctctgtaggcccctttgactcgcctctctccttcaataacaccaactcctgcggcaacatttattgtgtgctcacgggggccaggcattttgtgaggctcggggctgggagttgatgctgtgttggggtcaacagtcaaggggacagctaaattccagcacagtgaggtttgggccacagtgagtggtggaaatataaaagctcccctctgagaattggaaagcatcatatttttaaacaactgttgctggagtttaccttccttcttaaaggaaccccagctgcctgttcccatgatgccactgctggagtctcagccctgaggttgggcaagccgggggttgagactgtaccttctctgtttactgaaggtgttcctgtctatcttactgcctatgcactgtggtccccacagctgaaagtcagtaggcagaacagctggcccggtaggacccatttcttcaatgaaacagcctatggcccagacaaaagcccctgcatgggtgggtggaggctaggatgctctggtgagccccttggacgccattcctgtagtggtcacattggaatcaagtccattcaccgatggtcttaatgtggacagaaaattgaatttattaatggtagatgtaaaaatataatcaaacatttccatccatatcattgagtcctatccaacaataaaaaggaataaactattgatacatgcaacaacgtgggtggatctcgaggcagttatgtggtgaacaaagcctatctcaaaaggttacatactgtatgacttcattttgtaacattttttaagtgaaacaattatagagatgaggcacaggttagttgtcaggaaggagcaagtgtggccacagaggacagcacaaagagtggcttgtgatgaaacagcgccacacaggtgataaaattgcatagagctacacacacacacacacacatacacacgcacacacgcgcacacacacgagtacttgtgaagtctgaatgagtctgggttgtaccaatgtcagttccctggttttgataatgtattatagtcatgcaagctgttacactggattggcctagtgaagtgtctgtgggactttcttgtcaatttttgattgtggtaaaatatacataacataaaatgtaccattgtaactatttttacaggcgcagtttgttggctttaaatatattcacattattatgcaacaaacaccaccatccatctccagaggactttttatatcttcccatactgaaagttcataccaatgaaacaactcctcattcccctcacctcccagcccctgacagacaccattcaaattttcgtctctttgaatttgactactcgtataagtgcctcatctaagtggaatcacagagtttttatctttgtgtaactggcttatttctcttagcatagtgtcttcagggttcatccatgtcatagaaacatatcagaatttccttcctttttaaggctgaatactattccattatctgtatgtatagtagcccatccctgcttatccacaattttactttccttagtttcaattacccacagtcaacagcaatacaaaaatattaaatgaaaaattccagaaataaacaattcataccttttgaactgtgagtagttctgagaggtataataaaatcttgctgaatcctgctaagggcatgaaccctccctttgcccatcgtgtccactctgtctacactctccacccagtagtgacttaatagccatctttgttgccaggttgtctgccccagtatcgcagtgcttgtgttcaagtaacccttattttacttaataatggccccaaagcacaagtgtagtgatgctggcaactcaaatataccaaagagaaaccataaagtgcttcctttaagtgaaaaggtgaaaattctcggcttcaggaaagaaaaaaaatgatatgctgaggctgctaagatctatagttaggaatgaatcttctatctgtgaaattgtgaagggaaaaaagaaattcgtgctagttttgctgtcacacctcaaaccgcaagttacgaccacaatactggtaagtgtttagttaagctggaaaaggcgttaaattgtaggtggaatatgtgaacagaaatgtgttcccactgacagcagttgggttcggtactatccacagtttcaggtatccactgggggatcctggaatgtatccccccaggataaggggggaccactgtaccacatttatccatttatccatcgatggacatttgagttgtttccaccttttagcaaccttctgtggatttataattctttgaaaataaaatgttaaaaaatacaatcagaaatgaaatctatgaattggctcactctttcacctactgagtatgtaaactagtgtttgttgttgacctgttgacttttgtacagttcccatcacagagacgatttaagcttggtaggccatatagaacctgattttttctttcctgcttttaaagaagcaacacgtatgattgttcagaggatagtatgtgatattcagtgagctttaattaacctggcccatgacactatatacatgcttagatcaagaaataagaaaggaaattcagaggtctcttgcactgacaggtgatttcaggagagacaatgacattaacattgagccagctcctgactatacagaatatgaagccattctttttttttttttgagatggagtctcactctgtcaccaggctgcagtgcaatggcgcgatcttggctcactgcaacctctgcctcctgggttcaagtgattctcctgcctcagcctcccgagtagctgggactacaggcgtgtgccactatgcctgactaatttttgtacttttagaagagacggggtttcaccatgttggccaggatttctaatgcaaccaggtaaaagtaattagcaggagaggggaatgcttggctttggaggactcatttgcattgcaaagtatttcccattggtggcttggccaggcattcctttgtccagccgtgtaatggtctcaagactgcggagcatgttcacgcacagcatggacaccacttcatgtaggggcactggactgcctagagttggaggaagggaccctgtgagtaagcatgacctcatcctgggagctgcatggcggtgggcctgcaggtggggaggagagggtgggcgctcacagggcaagacagaggctcagcaaacagaatgtgtattgtggctgacgccattgtcatctttccaaacttgtttctgaaaggcatcacatggagaggggatgctgacagggatgacacagtcccagctccagaaacaccgtcagctgaacccagggttttttcatttttgtgttttctcatggaggtttaggggcttagtaaacccctttatgtgtattttttttctagggataaaccccatacctttcctcaaatcttcaaggtccatgacctcccgacatgtagaaccttatgctaataactgctcctgggagacctctcctcaggaactgacttgacccaccttcctaccaatgtggcaggaggaagtccctaaatgtgctcgagcctgtttgatccaacccctgtgggagtccgtgttcctctctccccactttgccctgtccttcccttgttcttctcttccttccctgtccttctttggctttgctacctctcttcccttcccattgtttttcctcccccctcctaggttctcacatcgctttcctgtttccctctcctgcaatatggatttgacatattaatcattacagcaactgctaaaattccactgtgcttcattaatccggaggaaaataccatgtcagctg

SEQ ID NO: 875 - DNA, 5267 bp, Homo sapiens
ggttcacaattctaacaagaaaagattcatttacgtttctttgaatgactttcagcttacaaggttctttataattactattacagatgaggacagctctgtgccagagaatgagctgggatctgccctgacaagtggagcctcgtttgaaagtgtcggtaacaggctctgtgtctgaaccaaagtttcccttgcaacctggtgtggctgcatgatggagtttgggccgtgacatatggtgggtttgacgtgtgccactcttagggccaacttctaaagcctccaagacacagccccatgccctgtgcccttctgcagctcagagcagatgagcccagtgaccttgaggcccttgaagatggtggaaccaggagacatgaggggccttggcctggaaacacaactcgaagggaaatcactcatctggaaaacgtgtttggacccataccacaccgtggcaaatacctggtaaaactgtcatctgaaattgcttggaaataggacactaccacctaaacccacagctcgtaggccagggcacctcaactgtagtccccagaccagcagcatcggtgttacctggaaaattaaaaatgcaaagttttgggcccacttcagaccccaggtcagaaattgtgggttgcagaaatctgtgttttaataacccttcagatgactgtggtgcccgacaaagttgaaatgcctgctcccatgtgtgctgggtttagtttgtgctttagcaaagcgggataagaaagaaaggaggccaggatggaattcgctggtttccaactagaagtgacagaaaatagaaagagtccagtaatgtgaggtcttgaagtgttgggagaattcattcatcacttctagattccagacaatcagaaataaaattttaaaagtctttcaatgacaaactaagacttctcagttgggaaaaaaaaaaaaaaaggactcagtcttgttgcagacatgagatgaagagtgtggtcttttcacaaatgcctgtgcaagggagtcaaggacagaagccatccggtgggctccttggcacgggggcggctgaagcaaaccaaccaggagcccacgcagctgtcaagggcttgtgtcagcaagtaaagcctagactgcttgtgactgtgaagtgtaaaagtgcccctgggtcctcaggcctgtggacaggacaaagccaaagccgcccagcgccgtgtgatgcggccacagagaacacgagcctcgggagagaggagcctggggctggaaaacaagggtgaaggacgctcccctctggctgcaggagaggggctgctgagggcaagatccatcatttcttgggaccaatgatgctgcttcctactctctgctttctgcctgggagttttgtctgggacgcctgtgtctgccccactcactgtgtggtgcaagctccatttccagtgaggacaaccgtggctgccgagagcaccttacaagccaggcatcctcctctgagctcaaggcagccttgagaagtgggacgaagacttccttcacgggaagaggagcggctcagagaaaggaagaggctagtccagaaccaccacgtggacatcttctgtgaaggcaagggctcaccctcaccctgacgccagccacctgcccctcttaataggagggcgggccctccccgcacagcaggcacttcactgcaggctctgctgcctttgggaaatgtgcctcccttgtagagctctgtggtgcagattcggctatcaaaggagtagaacccccccctcccccccgccaccgtcccacccccacagagcagctaagaaagctgtttgatttaacccgtggtttcccaaatactttagaccactaattaattttgttttctgaaacattcgttaatatgttcacagaaaattgtggcattcactttggaaaatatatctgtttaagaacagataatgaatacataacaaatttagaactgtgttaagattccataactaaaaccactctaaactttctgaaatggctgaaaacgtttccctaacttttctgaaagtacttgctgggcttcttggagactgaatcatcccttttgagcccacttaggggaaagttcaaaagacctcagagaagacaaaaagcagggcaagagagacggcccagtcttctagctctccactggagaaaatgcatgtgggaaaggctgggggtttccatcctcaatatttagtaaaagataaagtaaaaattacaactgccttctgaatggctcccctcccctgacttcatgggagtgatgactcagccctctgttttgtaactgcggagattgaaagtggagacgggacctttggcatttcagaaaatgtcgacgccgctttcttctgctttctccgggacccctctggggcctcgcctcctcccctcccgctgaaagcctgctgtgaaaggagcaaggatgtgaaaaagatgtacgactctttgcttccttatgctcggcccaagtttatcaaaagctgtggagtttgctaaaataatccagggaattcgcctggaaatggtttttttttttttttttggttgttgtttgtcttcacttgttccaaagaagcaaaataagacaggggctgccccttgtcctgtctcattcatttttgacacccttgtttctccacacaggccctggggtgaagggcacaggtgggattcagaatagaaatgactcgagggacgcaaggagttgggatcagaagaagcagcagaaactcctgctctgcagacacagcagacattactgggaaagacaccagagacccaggagttcacccaagtcctctgcacactgtcttcccagccctctctcctggatctgagatgatttcacttaaaaacacaagcctttgcttaaagggagatataagtgacagccacctggtggtcaggagaacaaactgccgccgtgtctccacaccctgtgtgtcctgaacaccgctgggaagccgtcagcagacgctccgcaggccaccggggcgatcggggcactaaaggccaagcaggcttcacacactgccaaagtccaggtgaccagagagtatgaccggacacaaaggtgggacaagccgtttctcattgttactgagaagcaactgtgagtgaacaaagcttacagagagatccgagatcagatgggtacccatggcaggaggggaggcgtttatgagagtccccggtgggcacatattaaaaaaagctaagtagaaaaatcactgagaactcataactggtcaatgagttcaggtagacaatgagggagggtttggaggatggcgaaagatcaaaggggccctgatggagtgggaggttcagagggaggagacgctgccatgttcagcctccaggagccaccacaggttgtgcataggtgctgtgttgacttctgctgaggaaattcacaaaatatacttcccccagagaaggaggaatgtggagcaggcgttaaaaagcagcctgcactcaccttcggaggccctcggtgggatgtcctcttcccagccctttcctttctctccctcgggtgccttttcctgcctggtttccttggttattgtgtttggaatgcaactttgactagttgttgaatggtgaagtggcaaatggtaggtggattctggcttgccgcacccatcccacaggtggaggtcttgtgagaacgactccagcagcctccagacaaatgactgttgactaaagtgaaatgttatgcacatgaaatgcaagagatgactagacacgcactggatggaattccacagcaggtgggagacttgggaaagatccttgttttcgtaagaaaacacaatctcagctgggtgcggtggctcacgcctgtagtcctggcactttgggaggtcgaggtgggcagatcacctgaggccaggagtttgagaccagcctggataacatggtgaaaccccgtctctactaaaaaatatgaaaattagctgggcctggcggcacctgtggtcccacttactcgggagtctgaggcaggagaatcgcttgagcccgggaggcagaggttgcagtgagccaaggttgtgcctgtgcactccagcctgggcaacagcgtgagatcctgtctcaaaaaaaaaaaaaaaaaaaaaaaaagaagagaaagaaaaagaaaacacggtcttcaaatcccataacctgagcacaaaagactcttggctcgctgattcgtctcccacctcctcctccccgcacagggacagatactgaccgggtgtgagagtaaggccccgtgaagacgaaccttggggagctcactggggtccctacttggaattttaaagcaaaaccatgttgctggaagtgaaatcctcttcagatttacgaattatggggctccattggaggaaacaatccctatgggccaatgacctcgtttcatcccaaattatcctctggttttacaactggttagtttcttgtatttccaggatttataaattgcaagtttgcttgtgaagtggtagaatccatttttgaatttgtttcttaactattgatagggctagtaaaattcaaatgattgcataaaccttagaaactaaggtcagttcagtgaacattcttggtgctatttcaacaatccttgaaggtttaacacgtctgtgatattactgtgtgatttcgtgttatcactgtcttatgtgcattctaagcatgaaactgtgtccagtagctgtttttgaggaccctactaattatacagctgatggtagcatcagccgtttgttcaatgttaaattattttgtattttctaaacaactgacattttctcctagcaaactactgataggaaattgtatgtgccatgttttcttccaacagtcttgaatatgccactgcattcctgcctgggtaaaagagtgagaccctctctcaaaaaaaaactaaaatgaaaaggcccaggatgaaatagagtgtttcaaaacccacagctactccccatcctttttctatcccaagagctgtgcctcagggatgtaataaaataaacatacaaactttctaaaggctgattttacaatttttaattaaataaatactactcagaaccttttcatggggtataactcaagttgtttttcagtgtttgaagaagatcaggttcacatttaagtcagctaattattaattatcagcaaaggcataaaatacacctggtggttatttacttattctcttagctttacttacatctttc

SEQ ID NO: 876 - DNA, 9270 bp, Homo sapiens
cttttctttaagaacaaaggttggagcccaagccttgcggcgcggtgcaggaaagtacacggcgtgtgttgagagaaaaaaaatacacacacgcaatgacccacgagaaagggaaaggggaaaacaccaactacccgggcgctgggctttttcgacttttcctttaaaaagaaaaaagtttttcaagctggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataatttttatggcccattttcttttgcaaagtacaaattataattccagaagctatctgccaaaaaaagacaatggaagaaaattatgaggacactaaagggaacattcctgactcctaggacacagtattctcatgtaagaatacccatttggctttgccccactttctgttcaagttgtatgtgctgccaagacaaatttcttctcctcactttctgttcaagttgtatgtgctgccaacacaaatttcttctcctaacacctggaatgagcttgtggctccacggagctcccatgtaggtagaacacattcaagagtgtttcttcaggccaggcacagtggctcacgcctataattccaacactttgggaggccaaggcgggtggttcacttgaggtcaggagttctacactaccctggccaacatagtgaaacctcgtctctactaaaaatacaaaaattagctaggcatggtggtgcgtgcctgtaatcccagatactcaggaggctggggcagaagaatcacttgaacccaggaggtggagttcacagtgaacgaagatcgtgccactgccctccagcctgggtgacagagtgagactccatctcaaaaaaaaaaaaaagtgtctgttcaattcattttatctgccactgtatatctacaagaggactccttgctttgagtcccagttcttcaaaatcctgcttgctgcctaaagacacaaagtcatagaacattaggactggaataaactattgtagtataaccttcctgctgttacaataaaaagctataaacattacaaaggcacttaaagaaaagctgtgctgggaaatgccttatttgaagagcatttgggtacactcacatgaagctttggaaagttacttaatcttcctctaagcctcaatttcttcatcaataaaatgatgaatatatttcatatttcataagatgtaggcttaaatgaaatcatgcatgtgaaaagcacaatgtctattatgcattaagtgttaaacacaaactttcaaacttttacatttcagtcatttaaatcaaatgatctaccatagcagatctccccaaagacactctagctccaaactaactataatcaatcccgtggtgacgacccaaagaaccagggttcctgggttttctctcacgcccagcccacctaggcttctgactgcctatctcctcatcttagagggattcctcctgaccagtcattacaaaaattcttggagcatgagcaagactgagtctgtgtttggattggaggaaggggtaagtaacaaggtatatatatgtatatgtgtgtgtgtgtgtgtgtgtgtgtgtgtgtgtgtgtgcgcgcgcgtttgtgtttaagttacaaactaaggatggttttaaaaaattgcaaaatgttaagagatttatctaggatctgacccacttccccagaaatttacggaattcaagaccaagcctttcgtattcactgtcatcagttagatggacccagtagctaaaaaattaaggagaaaaaaaatagaggaatatgagggaaaaagtcaagtcagaggactgaagaatatatacagaacatagaatattagaaattttctgaaaatagatgatagcaaatacctcaagaaagtgaggaaacgtgaaaagggagcttaaagaaaaataatagagtccatacatgggacacaagcacaaaaagctgactgagcatgtggttctctactaataataactggaaaacagtgaaaccagcaggaaaaacttgcacataagagtttaactttccactttgggtttcaaattctcccatagcaataagagtaagtgaaataatgttcacataaggattttttttttttctattactgtagtgttttgttttgttttgttttggttttggtttttggtggtttttttttttttgagacaaagtctcgctcttgtcccccagtctggagtgcaatgtcatgatcttggctcactgcaacctccgcctcccgggttcaagtgattctcctgcctcagcctcccaagtggctgggattacaggtgcgtaccaccacgcccagctaattttttgtattttaagcagagacggggtttcaccatgttggccaggctggtctcgaactcctgacctcaggtgatccatccatctcagcctcccaaagtgctgggattacaggtgtgagccaccgcacccggcctgttactgtagtgttttaacaaatctaagtgtaatagtattagtcttcattcatctaagacatacaagtactggaattttttaggtgggttcctcaaatgtcatcacagtggtgtcttctctacattcagtcactcttccgcccttctctgtaatgctcagggatttcccagttcactagcacttaacatagtatgtccttacttactttggggtataaatgactgcaatagaagaagtgatatccttgagggatgaaacacgatcttgcatattcatatccctttcaaatgtttactgacttaatcacaccattagttttctaagtccaagtctaaaaacagaaatgagtttaaatacagtgaacatttcattttcactataccactaagctgaaagaaatgatttttggtaaataaaagttcatcacagtgaaaagttctacatataactgaagatcaaaggattctcacctgggaagcttgtcaagatgcatgttcccaagctcccaggctcccactcccagagattctaatactgtaatggagctgaggacactacatttttaacaggctgaccaggtagttcagattcaggtggttcctaaaccaactctgaggaagtagtggttttatatacgatgctactgttgatgtggctactaggaatggtgctcagcagaaatcctgcaacatatggatctgtttacacactattcactgtgtaatgagagtctgcaacataggctaagtaataagagatgtcttgtggttgacctctctggagataagcagcaatgaaattccaatgaagtttcatcatctctcatcaccaaaaccatcctaaccacctcaataaaatacacctgacttcccccgctcccccgacccaccaccccaaaaccagctgccctatgttctaccaaaagctgcaaccaaccaatgacctgatactaaccccaatctatcagctgctgcctagtgcaacagagagggaaagtcaatgagaaggaattgggtgccagttcttgctttgcaaggagtgggttgactaatgagacagccacaaatgtcactgccatcccatctcaccctttcacctgtgctgcaaggcttcaacaatcatacccagtctccacttaggaaaattctgtcctttctcaaatgctggccactcagcaatgtgctcccttaatccaggccaagcacatagtaaaagaactccaaaaagggttacagccaaaagtgatctttctcctccatactcccaaagcagattatagctcctccataaacgtgcttcgcattgtgccccacgtttggtttgttacttgtgtatacattatcgtctcttctagattgagcttctgtaggaaaggagaatccttttcaattttttggtattacacccagctcaggaccttgctcagttgcttaaattgaatgagaaaatgtatctaagtacccactgatgttggaaattcaacttgttccaatattgaggactgcctatacctggcatatgcgtgtcccaatttgagaaattgtttttcaagttgacttgtatggattccttacagacgctcaagcatcagtttggttttccctaaatcctgcagatcaggaaggcagtatccatgtttgctttaagaaatttcattactataaatatatgaaatattataaatataaaaattcatatattataaatatatgaaattttgtctgcagaatttttttctcaacaggcaatcctgacataataaccaattttgagatgcttcaaaaataacactgcagtagtagccactcctaaaacaaaatatttcccctttccttcaatatatgtaatcacatatgacatataaaatctgcttattggataaatttatctttaaaagactatctatatttattaaaagttaaaatacatatactctttgacctggaatcaagtacaacaatgtattttacagagctaccagcacacgtgtggaattatatatgtacaaggctactaactgaagtattagtatagtaacaaaaattaaaaatcaaccataaatagggaataaataatggtacacctatgaatgaaatactaacttctaaaacacaaagtaaaaagaaagggaaaataaggaaaactggattaatccaacatatgacaggaaaggagaaaaaaataatgcaaagaaatgataatcacagtaaagtgaatacaaattaaaatttatctactaaaagacagtaattcaaagactagatttaaaaggaaaataagttttatgctatttacaaaagacagacttaaaacctaacaacataaaaatgctgaaagtaatataccaggtaaacactaaaaaaaaaaaaaaaaaaaaaaaaaactagtattaacaatagaacctgattttctaaaaaatagattaagaaaactagattaaaggagaaaatcattattaccgagatagagaggatcattacttaaatgataaaaagaagcaatttatcagcacgtttaaaaatcccaaaacagaatacacagtgctaacaaaatcatcttaaaataaaataagcaaatgctgatttagccataggagaaaccgccaaatccacaatcattttaggagaatgggtttaagaaaggaaaaaaaaaaaaaagatttctgtatgctcttaagagaaaatctaaaaaataatgacatgaaaaagttgaaaggaatggaaaaatatgtaccattaaaaggaaacccgacgtatgaatgccattatcagacaaaacagatttttttctttttgagatggagtctcactctgtggcccaggctggagtgcagtggcacaatctctgctcacagcaagctccgcctcccaggttcatgccattctcctgcctcagcctcccaagtagctgggactacaggcacccaccaccacaccaggctagtatttgtatttttagtagagacggggtttcatcgtgttagccaggatggtctcaatcttctgacctcgtgatctgcccacctcagcctcccaaagtgctgggattacaggcatgagccaccgcgcccagccagacaaaacagattttaagacaactaagaagttaacaagctgaccctacaataagcatgaaaattttgaaaaagaataggaaaggagaactcaccataagagaaattgaaacttgttataaagctatagttgttaaaacggtgttactacagtggtacatggacagataaatggaccaatgaagcagacccaggcactgaaaggaaccttttatatgacagcatggcacaatcagtaagaatagagaggaaataggccaggcacggtggctcacgcctgtaatcccagtactttgggaggccaaggcaggcagatcacctgaggtcaggagttcgagaccagcctggtcaacatggtgaaaccgcgtctctactaaaaatacaaaaattagctggtcgtggtggcaggcacctgtaatcccagctactcgggaggctgaggcaggagaatcacttgaacccggctagcggaggctgcagtgagccgagatcacgccattgcactccagcctaggcaacaagagtgaaactccatcacaaaaaaaaaagaaaaagagtagacaggaaataaatggtccagaataactgcctatccttgtggaggagagggtgattcaaaattaggtccctttcctcactctatatgcaaaaaacaaacttcaaataaattatacaattaaatgtgaaaatcaagactttaaaataaacaatgcagtaggctgctttataatatcaagttagggaaggctttcttaaatttcataaacataaatcatagaggaaaagatgaactgtctaccttaaaattaaagacgatataaacaaaattaaaaggtaagccagacaaaagaaatatttgtagtgacaacggtttaactttctttctttctttttttttttttgagacggaatctcactctgtcacccaggctggagtacactggtgcaatctcagctcactgcaacctccacctcccaggttcaagcgattcttgtgcctcagcctcccaagtagctgggatgacaggtacgcaccaccacacccagctaattttttgtatttttagcagagacggggtttcaccatgttggccaggctggtctcgaattcctgacctcaggtgatccatctgcctcagcctcccaaagtgctgggattacaggagtgagccactgcacctggcccacaagggtttcactttctaaaaatataaagaactggccaggtgcaatggctcacacttgtaatcctagcactttgggagggcaaggagagcagatcgctagaggccagaagctggagaacagcctggccaacatggtgaaaccccatctctactttaaaaatataaaaattagttgggtgtggtggcacttgcctataatcccagctacttggctactcaggaggccgaggcaggggaatcgcttgaatccagtaggcagaggctacagtgagccaagatcatgccactgcactacagcttgggcaacagagtgagacttggtctcaaaaaaaaaaaaaattatatatatatatcttatatatatacactattatatatatacacacacacacacacacacacacacacacacacacacacaattaatatgagatgcccaaaaatccaattgtaaaaaggggcaaaggttgtaaactggtaattcataaaaacaaatgaagagatgcttattggtactatatgctcagtattaagcaaattaaatgagataggatcgtgcatattcaaccaacaaaatatctgaatgtctgaaaataataaatgttaatgagggagtggagaaaatgggaatgctcatactgctgatagagagtaaactggtacaactattgtggcagccaattaatatttagtaaagctgaagatgcatggtccactgtggtacaggccctggagatattatcaaatgtgtacacaaagaaacacgcacaaggatattttctgcgatactgtaatactcaaaagccaatgacatcctcagtggtcatcaataagaaaatgaattaatgatgggattaatcatataatgaaatactatatagcagttgaaatgaatgtactctttacatgtatcaacatgctatacataaaaaacaatgatgagcaataaaagcaaattgcaaaaggatatatattatgaaaccaattatgtttagttttaaaacacagagaatactatggattgtagtaaaaaaaaatataaaatcatgaagagtaaggacaggtacaaacaggatagtggttcttc

SEQ ID NO: 877 - DNA, 3446 bp, Homo sapiens
ggtactccattgtctggtaaagttcatatgactgcattctttttgcaaggggggtggagggagagcggggaaggagggggtgtcagctcaactgtaaaagctgcacagattttttttctttctctctctctgcctctccatagattgtttctgtttcatgccctgtctcatttcgcatagctaaaaaagaatgctaattaagatcccttgtcttaacctgaaaaataatgactcggctgtaattagaaatctggtgagagtttaaaaattctggtaggggaccaaaaacatcagttacggtgcttaggaagaaaatgaagaattatttttctgaaatcaagatggatctgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattgctttctttagcttgcccatggtgatgtgaagatgagaagaaatagcaaggcccaaccagttcttcatctggagacagttcaacgttctgcaaaccagatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaaggtaaaaataaaaaacaaagagcaaataagatttactgtttttaaagaaaaacaacattcttttgactgtgttttgttataagaattaatttcatattctttatgagtgtaactgttgaaattttattgatggttttcatttgaaaatgtgtgctatgacctacctttgtgaaaaatttcttgtggtcaattgggcagtttgtgtcccattgaatatatgtctgtgtatccatacgcttaagataggtgcaatacggtttactagaaagctttataggaaaagaaaaaaattatattttcttatttgttgtaccatataaaaggaagtgaaatcaggaggaggggaataaggtcatgctttttcatcttttttacatgacctgataagacaatgaaaccaaaacatgctttcttatagttatggtaaaactaaacccaatgctgcctcttatttcacatttgcatttataaatatatgttgaaatatttttactacaactgaatgtatgattgttgattatttactatagtttttaataattatgaggacaatttaagaataaataatggtttaaaattatgtagaacacatgatctatataaaggctataaaacgtatttatttcaaaatatgcaaaatcactaagcaattagtatgtagtattattttacacaataaagatataattaggaaatgctaagtgattatagatgtgaaatgattaatgattgtacaacttatcattttgttgcagttgagtttacaatcttaaaaaaacgtgtatgtggctggctttatgtttactcgtttgtgtgtttgcttgttgtctggtggtttaaaacattttttagtaatattttatttttgcccaacctgttgaccagatgagagttgtatgtagccatgcattttaagtgtatcttttttgaacaataagtttaaatatattttatttaggaaagaagatatcctatgtcatgtaatacatctggagtataaatgttagtgtggagtattagtaatcatgccattatcgtgccatttagtttagttttatattaactcatccaaatattgtaaattttagcaccattccgactatagacacagatgtatatatttaaggctgataataacttcctgtattctctagctagtgaacaagatcttactgttttatgagaaagttataatgttaccaattccttgaaaccagtaactaaactagttttataaaaattaaaataagcacggtctaactcatacacaattaacttaatagttaatttggttttaattataggctcgtaatactacattcatgcctcacaattatataattcatacatgcatgtatggattcttttttcttttaaaactcaattagaatagtttaattccaaaatatttactattgaaacaaaagcagttcgtgaaaaatttttcaataaactactttttaaattctcatgcatataaatttgtatttagttttgaatatttatgaaggcctttaatggagaatatgcatccttagaactcagcatttaaaacatttatactaaaggatcaatattatttttgactcttaattgcatcagatatttacaacaaattctatattaatagggggcccatgcaagatgttgcccattggcataaacccgtagatccgatcttgtggtgaagtggaccgcacaagctcgcttctatgggtctgtgtcagtgtggtaatctgacaaaatgctatacacagtgccgttcaacaatagttcagtaaaatcctgttaaactccagttgattatatacttttgaagtcattatattttcctttgtttttaatgtttattttaatcattgtctgtcttacaaggcaggcttcaattctcaacaacttggaagcgtttatatcacacccattcaagttcgattccatgtacagtaaattgcataagaaagttgaacctttatagcagggtttggaccaggatctgaatagattctgttcagaaacttcagtgcatactgtagtgcttagtgtacctcttcaacttcagtaagaaaattaaagactaccattggatttatatgtttttattgagcctatttctcctgaaaaaatgaggctgaatgcaattgacttttactattaattgcgactagaactatggcaggttagatggtcagaagacattttacgtgacctatgctggaaacccaagtgtttaggttagtcctatgagaaacagttagcagcaaagtttactggtaaaatgttagaatattatatctatatccttgccaagcccttaggtgtatggctgccatatttggaggagctgactgaagatatgataaggagtttgaagcaacattggaagctgtgtgcatccgggttgaggtagtaggttgtatggtttagagttacaccctgggagttaactgtacaaccttctagctttccttggagcacacttgagccgtcgaggaattcttcatcactttaacctgattgagccaatttgtgtgcaagaaggtaat

SEQ ID NO: 878 - DNA, 4625 bp, Homo sapiens
cctgtctcccggacgaggacctcaaccccttcccccgctcggggaccccggccacccgcagcccggccgcgctgcgcccagaaacccatgagtcttcctcagcagctgtcgaaacttgccggcggttgcttgctcacctttgctgtctccccttcagaaaaggctggaggggagggcgaggaaggcttggcgtggggacgcccgtcgagtctctcagtgaggaatgagaggccagcttctcctgcggggtatgaaggaggaactgtatctcctatatatattaagtttcatttataaagacatcagagagcacctgagaatgtttcaaggtcaccaaaagctttctgaaaatgcctttctgcaaagaaggtttccagagatagaagataactcaggaagcttagaagaggtcaacctgggaagacaggattctttctccccacccgtggctctgcaggaagcaataccctcccctctgggcaaggtcgaccctccaagtccagatgagaagagttccctctgtctgctctttcctctgcctgatgacccagaggctttgcagctgtgatcctggcagcccctggccacctcagggagctgcagaattcaaaccctggaaatggagctctgcttgcagctgcacctggggcctgacctgcttaggacaggcctgtctggacctaagagaaccccactgccacccactcagctactccctaacagactgcagagaccaagtctttttcatttctttatatccattgatttctcgagttattgaaactcaatatttactgagcacctacaatgtgccaggcactgtgataggcactgaagaaagggcaaaggacgagcagataaatttcctacttgcagggaacaccgtggtagtgagtaaaatgagacattgcaaataaacacataaatatataatatgtcaactggcaataattgatgcgaagaatgattaagcaaaacaaggaaatgcagagacagggaaggagcatctatctggtatgaagtagtcagagaaggcctctctggtcagatgacatttgggcagaacctggggcctgtctcagcaccacctgttccttcctcggccacttgctccctgcagccaccaaaggcccctgtggttttcccgcctgaggctcaccagccacaggcctagaatatctggcttctctccccacgtccaaactcagctgaaatgccaaactgcaggaccttgtttcctgagcaactgccaatggggctgaatgatgcaactcggaaaggaagaggatttcattccccctgaatggactttgcaccagtgggagacaggaaacaggagattggaggatactgggcagctgaactgcctcaccctttccccctgccccgtctggtgcacaatttctccacacagcctgctgtgtgtggccaagcctgtgcgccgactgagtgttatgggttgaactatgttcctcagaaagatatgtcgaagtcctaacccccagtaactgtgaatgtggctttatagtatttggaaacagggtctttgctgatgcaatcaagttaagatgaagtcattaagggggtaggggcctaatccaatctcttgtccttagaaggagaaagacagagacacatcaggggaagatggtgaggtgacaatggaggcagagattggagcaatttatctaaatgctaggcaacgccacagagagctgcaaacaccaaggctagaagaggcagggaaggagcctcccctacaggtttcagagggagcatggcctcaccatacctttacttcagacttctagcatccagaactgtgacacaacacatttctgttgttctgagtgacaacagtgtgtggtgtgttattacagctgctctagaaactaacatatcgagcagccagctgtgtgggattgtacctcccaagtaaccctctaagacttaacctttgcccagggctctgtctctagagaactgtgacaatgataggtagacctgaataaagcgaaggatgatatctgcagggatatttgaggacagggagtgctgacaagggaggagccagtgcaaaggccccgaggtggcagtatgcttggtgtgttggaggagcaggaaggtgaccagggtgtttggggagtgaataaggggaagagtgctcagaggagaagtcagaggaggggccaaagacatgttctctagggccagaaaggcctttggatcttttcgacattatcttcttgacatgtaatttatatagtagtaaaatgaacaaaatgggtgactattttgtgaattttttagatacataaaaccacgtgatcactatccagatcaaatgttgaacatttccatcaccccagagagttcactcctgctaccttccagtcaatacaacttaccaatcctgaggcaaccagtactctctcttttatcatcataaatttgttttaacctgttccttaatggcatataaatgaaactacatagcatgcttttgctcaaaatagtgcttgtgaggttcatccaggttgctgtatgtatacttcaattattattattgctgagtagtattccattgcctggatatatcacaaattatttatccattcttctgctgaatatttgagttatttgcagtttaggcctataataaatgaagccgctaggaacatttatgtgttcctcttattttggttgcatgcaatcatttctcttggtataaacctagcagtgtattttctgggtcaactggcttaggtttaggttaactgtattcgtttacaccattttatactcccgtcagcaatatatgagttccaggtattctgcatcctcaccaacacttggagcctttctggtaggtgtgtagtggcattgcattgtgctttcaatatgcatttttctgctgactaatgcactcctttttatatgcctattattcacatatctccttttatgaagtaggtattcaagtcttttattcacattttatgttttgttatggccacatctcacttccagaatctgtattggttatctatcgcgcattaaaaaagtactctaaagcttgacagctaaaaacaacaaacattcattctctcacacagtctctgcaggtcaggaacctgggtgcagcttcatggggtggttctggctcagggtctcaggttgcatttgagctgctgtctgaggttacagccctacctatcaaagctgaaccagagccagactccatgtctaaactcacttatgtgagcttcagtgtgagaaatgtatgaattttgtttgatgaaatattgaaaagcttaacaacttcctcctactctcattggcctcttggtgcccagtatctgagtctgaaaaatctcatctataggaatcaatggcagcaaagacagaaccaaggtcccacggctattggggaggttggcagatgagtgaggaaaaaggggtgtcagcaatctaaaaatattcaggctcacagaaatataactgtttgaaatgactcacttttattaagatcctgccatctcacttaccagcttaaaaaaaaatagatcacagcagaatgtttcaaattctccataaatggccatttgatccagcaacctacctgtggaaatttatgccaagattagaatctacaaaatacatacagagatgcacattgaagtattatttattaggaatctaaattgtggaatcattaaagagaatacatattccctcaaaagaataccatggtgttattaaaagtagtcattatgagtggttaggatataatataatattacaggaaattcttaggatataccatcaagtagaaaaacttttcttcccagcttttcaatgtgaaaatgtttaaacctacaggaaagttgtaaggccagaacaataaatgcttgtatagccttcatctagattctccaacagtgaccacagttgccacatctctttaagtgtaatgctcatcctttgagagtaagtgcagacattttgataccatgctctaagtactacaacacctatctaaaattgtagaaggaaactcttctatgattttcacactcaagacatttaacactgatataaagtttatattcaaatttctccaaaagatttaaaactatctctttggcttgtgttatccaggactcaatggaggattgagcattgcatttagttgttgtgcctctttagttttttttgatctaaaacaatccctcaaccatttttaaaaattctttcatgacattgacatttttaaaagactctggaacagtcattttacagaatatccttcaatttggatgtgtctgtttcctcaagattagaaattacatgaacttcttggctaacttctccattttattttgtgttcaaaatatattactctttcccatgtcctgtgaaaataaaaaatctctaatgtgtttgtgaaaaagattaagctaagattttgtttggatgcagtgtgatttggacttaggtgtgtgtatctgaacttcatcctttgtcatcaaaagaatagtataataactaagaacatgtagcttaagaaatccaggcacttgagagccactgtaagtaaactctaattcccacagcagaaagaa

SEQ ID NO: 879 - DNA, 5970 bp, Homo sapiens
agtctgtactggcagcgaatcatacatagcttagtttatcagacaagctgcttttcttgagcaaagaaagaactaggagagaaacggggctttggaaccctgatgcggcaatgctgaaagaggagaaatatcccaaggaagggaaaggtgtgttgcagaacgatgaaaaataggcggcttctcacagctgttctcaggggacgagacggggtgggatgcagctccgccggtgcctaacactaagggccctcatcctgccgattcagttgtgtcgggaccgccagtgctgtctcctcgtcagatgctgcttctggtctccccgcagaagatgccactggagttgccttttcaaggatggggacatttgaaggccctggacgctcagctctgaggctggctgggatctcactagcaccccctggtggaggccggagccaggctgacgcgggaaagtggggcacggaagcgctgcggattggaccggcggcagctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagcccaacaggactgctgtgtgtgaagcactcaagagggcccctacaaccaacctgccaggagtcggctcctgaaaacagggtcggaaaaggtcagtgcccatcagaatcgagctgtcggcaaaaagctggagaggttaggagctttgtctatctcaagggtaacaaactgctttgaccctgagggctctgaagacgactttccctcaccgcagctctcaagacaacagggatcagactcagaaagacactgcctgtataaggctcttgtttgtcttgtttttaattcctgccctctgcctccagatctcagtcctctatctgtgaaacggaattcggccttgcctgtccacgaaatgaagacaaggcatctcgtgtgtgttaagatgaaacaagatcttagcaagagagtaatgatttcttttttaaaacattttttactgtagtaaaatgtactataacgtaaaattaccatttcaatcatttgtaagttcagtggcattaagtacattcacattgtcgggcagctgtcagaggtgttcgaaccagagcgactccatcttgaacaggtgctgcgcaaaatgaggctgagacctgctgggctgcattcccaggaggttaggcattcttcgtcacaggatgagtcagtggctgccagggaggcaggttggttaccccaggaaccaatgaattgcatctcaggggaggttttgccagatacaggtcacaaagaccctgctgataaaacaagatgcggtaaagaagctggccaaaacctaccaaaaccagatggtgacaaaagcaacctctgctcgtcctcactgctcattatacactaattataatgtattagcatggcaaaagacactcccgctagtgccatggcagcttacaaatgccatgacaacatctacttagttaaatttgcatactatgaatatgagtatgcaaatacctgttggagtccccgctttcaaagctttggggtacacatccagaaacggaattgctggatcatagggtaaatctattttggaggaatagtcgtactgttttccacagtgactgtaccattttacattcccacaaaattatttctttctatctgccttcccccactagatagaacacagggaagttactttttcgtttctaaatccccagcaccaggaacagtgtctagttcataacagagctctatagagaactgtggggaaagaagtgcaatttatatgctgctgcctcttcatttggcatctcagtacgtggcacacagaaagtaggcactgaagaagggttgaaggacctaatgagtacataaatgaatgcagttaccattgctttttccttggtctagactgaggacagacatttttgtaaattaagctacttagttaaatgtagacctctggccagttttgctcatccagaagtttcactttaatgccacttcaaagatactgttttctgtaaatcagatcataattgtgatgagaatgatgtggggatgtgtcctggactctccccatcccccacctcacagcctaatgtataacgcacattttattcaggaccattttggatgtgtaggatctgctccagaacacaggataatgggcctcttttctggggatggtgtggttccatcattagatagcaggtgtgtcatctgcaggtactggtctcactattcaaccactggttgaaagattggttcaagatcaactctttgaaaaatcaaagtattacttttacaaatgcttttttgatatttctcaaccaattaaccttgaaaagttcaccatgaagttgaattgcctaaacttatacattgtatgggcactgagatgcaatttttagggctgtgtgggcatcagcgatgcctgttttcaatacattgtagctatgctcagtgtcatgggccttgtagggctgacctctttttgtccaagcattgaagccaatctaaaactcttttccaaaaagaaaatgttttctttgctaataagtcaccatcaactgcagcagaggcagctgtttgggcttcacaatttgcggaagcacatgccagcctggctctgttttgtgcttgttcacagtatatggctttggccttgttcagcatcagggagtagctgttccttgggtcatgcatggagttggatttaaccctggctttcagctggccagtcctcatcaggagcttgggcaggagaaatagtactctggtgaatggtctgaagacattagatcatagatgaccttggctgcaagcaactaaatccagaccacaacagtttatccaaatagggttaaccaaacaagtacaatgtgtacccaaatgatatcagtgtcccatgatccttccatcatccactggatgatttcttaattcaaagtcaaacaaaaacaaaagcagatttgaaacattctcatccatccttgaaactggatcacatgccatggtctcgctctttgaagtggtcaactgaacagctggatacatggtctggagctgggaggaggagtgccttagtccattcctgctgctatgacaaaatagcttagacttggtaatttataaataatagacatttatttctcattgttctggtggctgggaagtccaaggtcaaggtgccggcagattcagtgtctggtaagctctctgtgtccaggatgacaccttgttgctgcatcttctgaagaggacaaatgctgtgtcctcatatggcagaagagatgcagggcaaaagggccaagaagccctcttgagcctctttaatgagggcattaattccattcatgagggcagagccctcatgactttgggccttaacccaaaaggctccacctcttaataccagcacaatgaggtaagtttcaccatgaattttggagggacataaacattcaaaccgcggcaaagagtctggaccaggggatgactctgtgaagtgcgtgcttgtccactgccaaaagaaagggataagatgaggaatgcgaagctgagaaggggagggttcgagatcagcactgcattgagagaaaggggagttgggcagaggagtgtagtagcaatggtgggcatggcgatggctcaaatgaagaaggtgattgcagatttccctgttgcatgcttggctccagtggtgttcagagctcaaccacatgctcagtgagagtagagagttgagtttacccaggcctgtagttctgcatgacaactgcagtgaaaagggataggggagggtgctgagcatattggcaagagtgttttcagagtcatggggcctggaatgcaagctggatatggaggcaagtgaagagaggctggtgggttgggagatgcagactgagagaccttctgaggtaggagcatttggacgagcatgctgggaggacaagaagctgtggtcagaggtggatgttcaagttttggaaggtggaacagctaggggtgatgacaaggtgtagggtgtgaatttgagagtggacagttggggcagcatagcacagaaggtcactgaaggaggaaattgaggagcccagagcccagggtgggggatgggagttgtctatatgtgtgtctgttaggggtcgagtttggctgcatataacagacaacccaaatagcaacagcttaaaagagacaagagtatattttttttctgatatagcaaaaagtgcagaagtagacagctcaggtctggcatggtgactccaagatgtcatcagcaacccagagttcattgatctttttgcttcccaggggtctggcactcttcctcatgcttacgagatggctgctggaattccaggaatcacatgcaaattctagtcaggagcaaagaggaagagacacagtgaaaaggggtatacagcggcagaaggaagctcctcaaatgaactctgctagaactctagccagtagcttctccttctatcacagtggccagaactgtgacaagtgaccatccttaggggaaaaaagatgctgagaaatgtgaattttgttgccaccttacattttcaaaggagttccattcgtaagtacagaacgctcagagaagaggcagcagatctaggatatggagcagcagctcttaagggcacagtgggaaggtttcaagactgaggaggatcttggatttgggtaggggaaggcagttcacagtattgtggaggaaatgctgtgaaagagaaagtggaaggcatggaagcttaaacttttaatatgactggtgaatacaaggatgaagggcaaagggaattcagactcatggtggtcagattaagaccttcagcggctctgtctcccagccccacatacccacttccatgttctgctctttactgaagctgaaagtctgcaaccttcattctctgactcccttacattttcttaggcttcttgctagcttctgccaaaaagaggccctggcaggagattagatggcaggaggcagaggtaaggattccatgttaacaggtgctggaagttgctggtgtggcaatgagaactgggccccggtcaaggcagcactactttggtagatccagaatcaaccatgataaccgtgacagtgtcttcaacagtgcagcagtagacacaggcccctggtgctggaatccaatacagggacaggagcagcacggagtcacggaacaccgtcttgccttcatgtcactttaccatttcttctttctccctcttactctaccagctacctgtggagatgttgaaccttttatctgtcgctgtctgcttaggaacagaagaaaaggcagctgattgcttgactcagctttcagcttgatttttttcctttggcagagtgaattggggtcccaggtgttcattttccttttgtagtacctttcctcagcatgcaattaatacaaaaagaacaataaaccttaacaaagtttggcttgtattattccagactttcctcttggattttatgtacacttatctgaatccatgcagatcatgtcatgtgtgtctgtgtgtttatacacatttttttttcggtgtgcctcattctgcaacttgattttttaaaaaattcgataactgatcttggagatctgtccatgttgttacatatatgagatttttgtatttcctttaattaatggtgttcaagtagccgtttatgtaacgatgaacattcaggt

SEQ ID NO: 880 - DNA, 1805 bp, Homo sapiens
agacccttgccatcagcagaggctgccgctgcgcgtcccctaggcgcggaagaggcggctggtggtccctgacggttttatacattacgaataaagctggcacgtttccatttctcctgggcaaatatttagaagaaaagttgctgggtaattggtggagacaaggtttcgccacattgactgggctggtctggaactcctgagctcaagcaaccggccctccttgacctcccaaagtgctaggattacagaagcactgagaccacagaggcaagagctggggaaggaaaactgcccatgagatgagatgtgcctctcagcttccaaaatcggggagggttgcaaagggatgacaccatccacaccagaactgcatgaatggcatcaggaatgatcagagaccataaattccagtgagaccaataacaccatttctggtcctgcatgctcttccaaactttgccactaaccccttcaagagatgccccccatggaatccagccatcatgctgtgaggaatccaagcagctacatagaaaggccacaactagatattccagctgtagtcagctgaagctccagccaacagccaacatcaaccaccacacgtgaaaacgagcaagccttcagatgattccgactcccaacctccaagccacctcagctgaagccaagtagagcagagactagctgtcccccaatgctctaatatgcagattcataattaaaaagaatgttattgttctaagccatgaagttttggggtggtttgtcatgcagcaactggaactgcctgatcacaccacacacacaaaagcagaaaacaatgccatttcaaaatggcattgggccacatggaatcctgcctcccagccaacccaactgcttctagctcagcacttcctatttcttttttcttttttcttttttttttttgagatggagtcttgctctgtcacccgggctggagtgcagtggcacaatatcggctcactgcaacctccgcctcctgggttcaagtgattctcccgcctcagcctcctgagtagctgggattacaggcatgcaccaccatgcctggctgatttttgtatttttaatagagacggggtttcaccctgttggtcaggatggtctcgaactcctgattttgtgatccacgcgccttggcctgccaaagtgctgggattacaggcgtgagccaccatgcccggcctcctatttctcaatcacaatcactacacaacttccttcagtagcattggtcactacctcttttctcagtatccaagttgaagaagagtgaatttatgacctctgcagcttgacaatatttacaaagaactctcttgagaagtgctttataaaccttgtcatttaatcctcatgcagctctataatttaatatattatttccattcaacagagcaagacacaaaaggtaaagaaagcaagtaagccaggtgcagtgactcatgcctgtaaccccagcactttgggaggccaaggtgggaggactgaggccaagagttcgcgatcagcctagacaacatagcaagatcctgtccctacaacaaaacattaaaaaattagccaggtgtggtagtgtgcatctgtagtcctagcttcttggaggttgagctacttgaacacctgagcccaggagtttgagactgcagtgagcctcatgattgtgccactgcactccagcctggacgacagagcaagactctgtctcaaaaaacaaaaaacaaagagggcaagtaatttgcctaaatttcagtaagtgtcagacttatattctc

SEQ ID NO: 881 - DNA, 1733 bp, Homo sapiens
ggtcttaactgagtgaagttgtgtcagactcttgagccacagaaatgcaaggtcttacattttacgttgttttaagccactacgtttttggtaatttgttatgactgcctagaatcctaatataccaccaaaatgtgtggcaaaaataattattctattgacatttaagaaagggatgggaaggatacaatttttaggaaagagttctactgaagtgaaatttgaactagctttgaaggactccggaatatgaacagggtttaggaggaaatagtcattccttccaagcaaagttcacagagaagaatctgaggagaggcctctgactaaagcagaaggcttgtgtggggaaggagttggaatgaactctggattagaaatgtgttctggagggctttgcctacaacatgagaaatttgagctatcggaggaaattcttatttcagctcacccctatagagaagctatatgagtttatctgcttgctgcctaacatgcactgacatcattgcatcttgctgccttctcacacgcctcttcagcaacatcaaggacaacaaccaacaaaaagaattcacatttattgagtgatgactgaatactatgcactatactaggaactgtattcatgttatatactaaatcctcaaatcctgtttttaaatgaattcattgaggcttagagagattcagttaactcacattaggacacagaactaccagggacaaatccagtgttcaaatctagagcccagagtcccagctgttttatgcaaggccatctatgaacatcagatttgcatttcatttttcttgcctggagaatattttattcacgtgtgttttattaggcatctctagatacaataaagattatgcatgctgacatatgtataatcaactgttttaaaaatgaaactgaaaaatagatccagtcattcagaccagagagaggcttataatgaccacagcatgattcatccaaaaattgttaatacgttatggccaaaaactccagctggttacaaaaatgattcaaggatcaaatataaacctaagcaaatttgcatctgagtctaaaaaaacacctggcgtttatgcaactatagagactactatccccacagttttatctgtagtgaagtgcagctgggaccccagcgttgaataggttaatagaattgcttttgttttattccgttgaaatatctctctttgctcccatcattctccatagattgtcatgaccggaggtaaactgaacatctgaaaaggacctaattaacattgtgcgcaagtgaaagaataaatgaataaatgaataaaagaatgaatgagtacggatgctgagaactgagatgtggcatttccatactggcagaagctccgaaagaaacagtcatcacttcctgtcctactgcacgcaatgtgttaggcagtgctttgctgaaatccagaatataaagttaaactttatgagttaaaagtttgaacttttgagcgagatgtaattaagcacaaattagtttgtagaatcctaaatgtcagtgcatctaaacaaagtacatctatgtttatttgaaagcaaaaaacgatgacacatttttagagaattaaaataaactgatcattgaaattgaattaatttttaatggtaaaattaatttgagtgaagtagaaagaatgcggctcataatgttttattgatgatgcataaaaatgatcacaagtca

SEQ ID NO: 882 - DNA, 2603 bp, Homo sapiens
gcccactcacacacatagagtagcatgttatggcacttacactaataaagccactgctatcaaagttctggacttgatttccagcagtattagctctgttttaccctcaagcttctgggttagtgggttattgctcaccaaagaagttctggttggaagaagaggtaagatatctccagagccgctgagaagaatgagtaaggtaaaactggtggcattcctgactgaatacccttcactcacaggaggcagtgtggaacagtgggaatgaggagtgctatgggactttgtatatctggtctggaagcctgtttctggtacgtacagctagggatttgtagaagacttcaggactccagatgactctgaaatacttagcaacagtagaagataactacataagaggagcttggaactttggctcaccatggggaagagcaccactgaaggctgactatatctgcactgaacttgatggagcaagaataaattttactctccactaacatctagggggttgtattttacagcaattgccaccatcatcaatatagctgatactgtgagacagaaggtaaagtctgaacaagtttatagcctcagtgcaagtagctgaagaacaaaaccactaactctgtgtgaagaaggatatcaaggttttttaaaaacaataaaaaatgatagtgttgtagacctagttacgcatcatataaaatcctcccatacctaccagcttatgtattcatcctgtctttgatcctggcccttgcctattttctaagggacagacgtaacgataactcagggacttcccaggtccagactactccccctgctctaccaccaacagaagtttggcaccctcatgcgatgcattggctgacaaggaaagacttaccttcacatggtcatgctggacccacgggtatctgcttctctctacccagaggggccaaattacacatcctctatgtgaaatgtgaatgagtcaatgctccatggggcacacttataccaatgagaaaccaacgagaaacagaatatgagattttctctttctacaaaattttagaaataaaataagaaaaaaatagttcacctaaattaagcaaatattttcctataaagcacccacattttcttgcaataaatacattaacctggagaaatgtcactaacatgtcaaattaacttctcaattaataaaggccaattttgatgtatttctagcactttcaagctagaaataatgtgaatagttttaaactgaagtgttttacactttagttttacagttttacagttctggtaaatatttggcttctgtgcttttaagttactgttgtaactctgaagccatattttgatttaatcctgaaaggtttcagaaagaaatcatggactacaaaacttgtatagagtaactcttttgttttaagcaaataaatacaacgttaaaaaattctgcattggacaaaagtaaagcagtttagcttactcaaataaaacacagctgaatgatgatcagtgtattcttctatatgttattgtatcttcaacctcaccagacttttggctggtagtcccaacaatgtgtcctaaacttcatattacctgttttgatgttgattttcactgcaactgaccataaacacttcaagttagagactgttattgatattatttctctttttaattattaatgttatgtgaagtaacaagcatatagtagggaatcaataaggattagagaaattaacttaagaggaaaaatacacatctgaagctgaaataaaatactcagaagggaagtattacgggagatattttaaggacttgacatttcattgattaagatttctttttttcctcattgtgtagtatcaaagatctttcaaaaattacagggatatcaacatagaagaacatatttagaaacatcacataatgattccaaaatattgtctttacttttaagattttttagaaatctctctaacataaacttccttgggaatgggatcacttaaggataaggaactttggattgctgcagagccataaattacaaattccaaccagctgacagattgaactttgaaaataaagaaaaatgcaaacccacaagtttaaaatgtaaacatgttgcccaaaaccattaaaaagtcagtttgcatgatactctcaaggttgttttttaaaaagcctgtctgttaagtaaagacagtattgttcaccctttgaagctgattctcaagaaggggtgcccttctgctactctctatgaaaataaaaatgaaaataaaatataaggttttatttcctgcttagagttgtcctaggcctgtgctaatgctttctactgctttatttctaaaattttgtatatgaagctattgctacaggaaatcttttttttcttaagactttaatacctggtaatcacactactgtagaattacttctctataaggaccttatcagtaggatttagtaggcaattcaagaagataacaagccatgaaaagatttggaatttttctggctatgagataatcaatgatgttctataaaattctgggaattatatcattttggaacta

SEQ ID NO: 883 - DNA, 1866 bp, Homo sapiens
cagtgatcgagtttcacctttgtaatgaaattcattgcaaaaggagaaaacaaatggaaaattatcaagttcagtgatttaatttgtactggacaaactttaggcccaaggaaggtaactgaattggccacatagctgatagtattcttcctgtcatgatgaaccatttgaacatagttgtggttctttaaactataatcttaaatgtacaatttttaaatttcatccacacttgctcataaatatggtgtgtatcttttatgatgattctttggaagtatatgataagtaaactaatggaaattcaagatactcatacagttttaacaattgtaaaatttcttgttaatcagtctggttatatgagatttgtgttgattctgaacattcattttgtagtaataggcttaaaacacaatggttcaggtgttcattagtttatgcatttgcatgtaagtaacagtagtaaatttttaaaaatgaaaatactttataaatcatactataagtgtcagtagtttaggcatagataggtactaagcttaaatattacatagataacaagtttaaatattacaataaaagaaaaagtgggttttcaaatggatgcttgctacttgggatttcttttatgggtcattttgtgtgaaatgagacaatccatgtgcaatgcagcaaatttttttttgttgttgttgtttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccacgcccggccgcaaattttaaagatacagattaacataaaggatataaaataatactgccactgagaggtagcatcactgttaacatactgacatacattgttggtattgagctggatggggtgttgattatcctctcccaataccaatacccctaacacataacattgtggtacgagttgttattgatgaaagtatactttataagtgaataaaagtggcatactttttttctgtggacagcattgtctaatttttaaaccaaattaagaccatatttactgtttcctctgttttggtgatgaatatattttaccatttttttcttatggatttttaaagtgaaatggtaaatacctgattagtgttttaatgatttaatttgctgtctttttaagactgtttttcctcccctactttactgctcagcaccttaagaattcctgagctcattctggtttccttatgggctgtcattagatgcgtcttcttctattgttttcatatctttatttgagcatttatattttattcagtgatttctgcatattgtgaaattgtaaaaacatcatatttatcataggatctttgaaatctccagtgtttctctgtatactgtgtttttctatttccattataatcacataaggaacaaacttccagtttaactcccaaataaaagcctcattactgtataaaaaactttggaggcttaatttgctcttgtgcattcaagcaatatttcagataaatatgacaaatctattgttttttaaactgaggttatatcaggcttaagatttttttttttaatagagcaccgatggttgattgttgattggttttggttaggtttcctaaaggctgttaggattggttttaaaattagtact

SEQ ID NO: 884 - DNA, 4926 bp, Homo sapiens
gagtaacttctctactcttttattaaaaatggctaacggactaaatgtcagttacataagaaagatttaggtttgtctgtgaaggtcatatctaccggtaccatgaaatactgagaaaccacgttgttactctttttatctttcatttgcttttaactacactgctttctttatgcggggcattttatataatgtacctaacatgccaacagaaattgtatgttcttcataaactccagaccaatgtgcttttgcagtgatagaagtgacctgtgaaatctgtgtcaacctcagagccagggtaagataccgtcatcacactgccagcctgcctgcttctctgggtccttgtggcaggggaaggagatgagacagggagtaggagagagactgactgctacaaagggacctgtgcagcttcactcttatagccactgtctgtgtggatctcttttgacaatcatcttttatcaagcaacataaaaatatcagtactattaagtatccataagaaggcaccaatcatgagtggatatttccatatataaaacctaggtttctttcctttcaatatgtgcattgagttcaattctcatctggaaacagggaatgaaagccgcttgtatggatagttgtcaggaagacatatacaggatataagttaaaagcacagacaagcatgttctgtgtttacagggggcaggaactctctcagcaagaagtcctggtacgacaagacagttaaaggcattccaggaatatactgttttcatttggctgtgagtcttcctagaaaatgtaaaagaaagttttccctgttaagataacacattttctctttatggtttcatgagggcagaaggaagctctcagctgttcttacataaagccttgtctgagaggtatgggatgcctgatattttttatgcttagatttatataacattatagctcttcttctctttgaagaggcaatatggttgaataagatcataaatttaaatttactattaaaaagtattaagtattatgtgtaatacacactgatttttctaaaatgcaagtctgatcttgtcatctctttctaccttaaaatttattataggtctcctattttttagaacattaaaatccaagcttcttatgggatgcaaagcacttggtggcctcatctcattgttcttctttgtacttgagcatcatagagttagttacttgtagctttgaattcgtattatttttccacacctctgtgacttggtgcataggctttaataagcctgaaatgtcttccctctcttcctatgtgattgattcctatttatcctcaacacaaaattcagatatcgcctgctgtcttgagtcttcactgacttaaaagcagttcttatgtaggacctctactcctgttcatatttatgatgttgcctttataatgctatattttgtctgtttcatcctgtgtgcctgtattttttctttttttatactgcataattcctgggatccagattcatatttccaaaaaaacatcattgtatttccagcattttacacagtccctggcatatggtagttgtttataactttttgttaaagatcttccattttgcaccttatgataattgttagataaaaatctaaaataatgcatcactagaaaatgtaacatagtaaataaacattgcatatgtgtgccttataatgccatgtagaaaagagtgtgctcaaaattccttattggataaagaagcaaaaggtcatcgtgacataagtctgatgcacgtaaattaaagagttatttgttcaacaaagaacagcaataacaaagtctcccaaaatctgatgtcaggattagctggtgaaaagattaagatgtgttttttttttctctcattgtcccaatacctctcaatggaaccaacaaatatctgctgcaatgtctgtttcttaaaaattacctgttgggcaccatgtacactattcaagttgatgggtagactaaaagcccagacttcaccactatacaattcattcatgtaaccaaaaaccgctagtatcacagaagctattgaaattttaaaaaaaattagcctgcttcttagccaatcactactgaagttctgcaacaggcctatcaaccaagacgtatgagataaattgctcattccacctactgtttctttgtcagggtactcgcaaagctatggacccaagtctttgagaagccctatcactaggaataaaggataagcatgaattaacagggacagaagtatacgagaaattttattttgaagcaagatttatactaccccacttctgtaagatctgaagtatcagcactatttgacttgctgcagaggaaatcagaactagtgtgaggacctgtaaacttatatcagcaacttggaccttgcctggccaaagctgttagagcagtatgttgagacacctggagctacagaaggagtcacgctcactaaaaagatgccaggacatactgagaaagctaaggcagaaatagcacaattgagtcaagtgctggattagggccagaaaatgaagaaaaatcacgctgagatataattggggaatagaaggatctttgaacaagcatcgggaatactaagtagtttttgagtggtgtgtagacaggtaatcttggaataaaatgttttgtaaataataaaaaacaccctctatttcctctatgggataaacattttcttcaaagagaagaaagtagagagcttatctgtgccaggaattctaaggcctcagtggagttactgcttggaatttctacccaatcccctggtagcaggcctcctggccaactccatggagcctgggttttcacaaagctggagccttacagaaagcacaaggtaagactgagaaatagaaggctgactttaagaaaaggagtacaatactctattgaaagttgtcatctagatgttcttctacctgagtgttttctggacaacatccttgttcatttggcagtcaagtctctcaagaacgcttagagggatgattgatgacctgggctggatcccaattctggaacaagatggcatatcctcgcttttctctgttcctcagtggccctctccaggttgcccaatgacagtaggtagcccaaggaagtaccttccacttccacagatgacaccagaacattgattgagcagtaagcccaacagcatgcgaaaaatgaagaaccattcaaccagaataacattgcaagagctcagaaaactaaactttcattggaactaaagccaataaaagtaggacagacctgacaagcagaacctaaacaggacaactgcctgctaaaacagaaggtgtaaataggatcaagtgtctcctaacataagaactaaaatgtccaggatgtaacagaaaatcattcatcaagaaccaggcaagctacaatctgaatgaggaaagacaatccactggtgccaataataacaagataaattagatgttggaatatctgacaaagattttaaagcagctgtcataaaacacaccaaaaatcaattacaaatcctcttaaaacaaataaaaatatagaaaatctgagcaaagaaataaaatgatggaaaatacttgggatagcttgcatagcaccatttccaggccaacttctatgaccctggctgcttttcaactaatcataactattagacatgttaggaacagttctggattggaataccccctgggacaaacaaggatatgtagtgactcttaagtttccttatctgtacttcaaatttcacccctcttccctcttttcctaattttcctcagtaaatttaactctttaggaaaggtcagtggttcactcagctcctggacatgattatagtattctaagaactaaaaataacatgtattcatgctctgttcagggactacccaacccgacctgacttgttgctgtcaaaattggcaggtacctacaatactgattggggtggggagggtacccttttgttaaaagttcctggttttactgtctctaagtctatacctagtttgaagatagatggttttagtgaggtcacatatactaatggaaacagagtagcagctgatgaccaagattgcctttagagtttagaaacactgccttgaattgggcttatcctaagccccaaattttagcctgcactagccaagttgattttattattagaacactttaagttcatatctgtcatgtagcaagcagtggaaagtaacagccagacacccaagaatgttatcaaggtctccaagcactggcaaaggcattatgcccagaaagatccttgcgatgagacattttcagccattcaaatgtagttacaactgaccaaggcaaaatggggaaataatagtacctgcttcatcaggttgttatgagtattacatgagacagcacattagttataatgatgatggtcatggtgatgacttttctggaaaccaaagaagggatgctattctgcagggcttagaagtagaggagcataaccccctaaaaacagtaagagaagctaagactaaaggggtgggttaagacagagcccataatgcccaaatgccaaaagagtggaaaaaaagcaacaaatccgtaagagaaagacaaaacagagggatacgcgctggatgtcaagtcaagaaagcagaaccagagggtgaaaacagcttaagatcaaatggactggtggctgaggggtctcaaacaatgtccttcaatgttgtcgctatctgaagctgacttttatgatgcaatgttaaggagtatgacctgccttataggcccaaaagtgggaaggcagttgagaggccatcacaacaaataattattcaaaaccagtttttgtattctagttttggtggtggaaagctgaaatgctt

SEQ ID NO: 885 - DNA, 2406 bp, Homo sapiens
acagactagccaagtggctgagacgagtgtggggtgcgtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacagatgcagccatggacaagacaaggagagcttcgtccctcccgcccctcgggttccttcctgctggggtctgaccgcgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactggggaccgctgcacccctccccgcccgcaatgtcccttggagtccgcacctgaggtcccaggcaatcgccgctaacttgtagctctcggacacggacaggtgcggtccatgcctggtgccggtagacgcgcagaaattccacctgtgcgcgctgcccggcgcccctggggcccctcacggggtaagtagagactcatctgggagaggtgaaaattccccagaattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcccgggacgcctgcagccaccgccagggtcatggccatggcccacgcagggctctgcgggtggagaggggaagtcagcctagactccagagagaaaccctggggcaacccgaaaggcctgaggaaaactggaattggggttaggcatgaggggagggagtctctggggaaaacgggccgggctgtgcggagccctgagggctcctgcggctgcagcgctgcaggccgcccgcgtctcgccccgccccgccgctgggcgtccccgccaggagcccacccgcgggcggcagcttttctccatgctgcccagggaagttcgatgcctggtgctgggatgcgccagcgcttctgttcgcttctggcaatcctggcgtctcccaatgagagggctctcaaaatgaagcttttaataaactccagagtaaggaactcgggattgtgcggcaaaggccgcgcattgcactttgtgagcaatcggtaaatatgcgcaaccatatgataggaaatatatgcattttcattgataagaaaaaaagagatgatggtatttttaaacagaagccacaaacaggcatacctgtgccattgttggggagctaataataaaggcactgatgatcacaggagtaagaacaattgacttggccaagagacaattttaagctgggaactgtattcggctgcagttcagaaagtggacttttgagacttgtcaaacgaatggaagaattttgtgccaacaatgtcccagctttgcaggcttggcagctgaggactcagaagtaacaaattaatgccaggtgaattattattgttactactattatcaaaatgtgttccagttgcagcaatacaatggataagcaacttc

SEQ ID NO: 886 - DNA, 7999 bp, Homo sapiens
agtgacgccatcagccgtcgcctgagccgtggcgcgcgggtggccgaaaggcgaaagtgagatttcaagggccgggtctggggccccgcgggcgcgcagtgctgcggcgtgtggggagtacggggaggctggagaggagccggccccgggcagtgtgaggtgcggaagcgcggtccagacactttgctgacgggaggccggtccgccagatccgggaggtggggcctcgttctggactgctgtacgtagttttattcctggtcatttttttccaccgccaaatcgagagatagagctttggatcatgagagatggcgtcgtgttgggaaaagagccttctttacctgagtttaagctcggctcatagacatcctctacctgagtttacacgtgtgtaatatgaaggcagtcgattaggagatgtctaagatcattacttacacctcaagtttccaaggggaggaagacacgggaaggatgcgtggtctgtgccagactttgtagacgattcactgaatgaccctgatttagctcttccggccctcttcgattcagcttggaagcaagcataaatagtgattgttgtctgtatacttctctcggaaggaatgctgttatgggagttgtgggttcatttttaggtgtctgaagaagtttcaggacttttgaaatgatagtggagcccattgaactcagaattatccctttctggtctagtaggagtatagtggcatacggaaaatgaagcaaacatcaaagacagatgtactggcacaagattaaaagtatgtctcagctgacatagttgccattttaagactgcttagtttagctgaatatgcctggattttttttttttttagcattttttttctttttagcattggcataccatatgaaatgtgggcagttgccagtactctacagagtaccaaggcagaattggcaatgactaaatcaattcattcaaacaaaaattcatcatgtgcctactgtgcgcataatttgtggaatcaaagtctcttgtttccaggggctttacagtgtaataagtgctatagtaaatatatatacggagtggtaaccatctgcctattcctctcctacagtcgttgctgagttccagtgtagaacagagcactgcattgtgtatctcaccactactgatttagattttataatttcagctgcatccctccctcctactttgtatattcttcagcatctttttctccctttccacttgaatacttttcgcaatctttaaatcccagcccattttattatatgacttttaacttagacttcacaattttccaagtgctagaaatttcctgagattgccttttctccagtatcaacgaatgagagactccctgttcatatatgagataaactcttcatacatattctagttccaatacccctctttctcatgcatttattatcttttctgttgtcaaccttctacaaattctggttccttagctaattcttctgtagctttcaattatttccttcacaagcaaactttctttctttaaaaagtattctatactcaggaggctgaagcaggagaatcgcttgaacctgcgaggcggagtttgcagtgagctgagatcctgctactgcactctagcttgggcgacagagcgagactccatctcaaaaaaaaagtgtctacaatcagtgtcttttttgttttctgaaattgacttgtcagccctctgcagtctagtctctgtgtctatcgtgctgtgctaccaaaaatgctctctttaaagtaatctcattgtttggaagaaaatgagttttttgttctttaatataatagtgaaatgatgatcctgtttcactagtaggataaggttcaaaactattaaaatggacaaggcatgtaaagtcactttcttttatttttatctttttttccccccgttagaacctctggcagggactgactagcccatgaaacttatttcttcttcccgggcacacagctaaactaaatttcacagctttccttgtagttggttatagtcatgtgatgaacttctttttttgagacagagtttagctcttgttgctcaggctggaatgcaatggcacaatctcagctcaccgcaacctccgcctcccgtgttcaagcgattctcctgcctcagcctcccaagtagctgggattacaggcatgtgccatcacacccggctaattttgtatttttagtagagacacggtttctccatgttggtcaggctggtctcgaactcccgacctcaggtgattcccccacctcggctttcaaagtgctgggattacgggcgtgagccaccgagcctggccgtgattaacttctagccaattaaatatgaatggaaatgatgtgctcatttttagggttaatgaagtcctcctattctcccttactctttcttcgtcaacttgatgcctttgagcatggtgaccttcaaaactatgtattggagatgccaaagccagaaaagagaagaatgagtggctgaaacagtacttggaagacagccaccccaattagaaacacccctttttgcacttactgtaagagaaaaaattgagatttgagaatttatatgtataggagctagaatgaccatagctagtccagaaattggtacaagaagtggagtactgctaaaacaataacctaaaatatgttacatcagcttatttatgatgcagcaggtggtagagaatgtgatttggaggctagaaaaaggaggcccatgtttgcagtggcaaagtaattagtaaaactgtcacctgaaataattcaaaatcagatcacctatctgtttagattagctccagaggaaatgattgaaaagagcaaaagtaatactgtgttgaattttacattttacttttagtaaggttttactaaagagagaaactcaggaaatacttcacagaagtgagagtgtacaggaatatttctcaggaagggttggaaaagttgacttttataagacttctaataaaaaaaaaaaaaaaactagaagaggtcttgagtatagttacccttgagattaagtcctgcaacaaagatcaggaaaagggtttggtctttccattcaaagtcattattttagatggcttcaagatagctacgataaaggtctaaaggaactggcataggagcaaggcagcaaagcagtaaattaggcttgataattatgtaagaaagaactttgggtgtagttaccagaagcaaatcaatcagaagactacatttttagaggaattttattaatcatactaaatctggctcaaatatcattgttcgggtgttaaaacagagggtaactgtccaaccccaagcttgcataagtagaaaaatagagcataaaaccttaacagctccccagtacccacacaggatgtggccatggagaatgatggacaaaaaaagaacatttcagaagctcgtataaggagctgtactaaagactggacagggagtttctcctgaagactagaattggagtttcatcagaactttcttcagtttcaaggagatgggccgcaaaatgtttatgcagtatttcatcattattatacatgaatagtattgctcagtatcacattttttttctgaatgagagaatgtattatagttatctgtccctgagttaccactatatattgggtttgcagggatgggggtgacaataaagataatttgtctttttagttcttaggtcacatctgtacctaatgaagagaactgcacattttctgaaaatcctagactttgagcctgttccagtaactggttaaaactttagattgtctcctttgggacagggtatgttctgtgtgtggaaagacaggtaaaatacatgtttagtgatcagaatagtagattcttgcaaatgctaaattcttctggccacacagctatatttccatgcctctcttgcaattaggtatatgggttaggtgtgctgattaggttctaaccagtggaatgtgagaagtgatgcactcctattccagctctggcctatggaaacatcacatgagcaatccaatatatcccactccccatcaacttgaggcagatgagcaaatttgcactggaaactatgtgttaaagatggcaaagccgcaagataggactcctggtttcctgaatcttcacttggaggatacttgcttcccaattagagacacttgtgctagagtttcctgactcttcactgggaggatacttgcttgccaattagggacacttgtgctacagctcatacgcattcttttgtgttaggccactgagatttcagagcgtgccctaataaagacctgtccctctttctccagatgcaatcgttcattacctaattctaatttttataccacaggagtaggcccacaaatcaggctagccaaagtatcctatcattcagccatagtgattagttcaggaatgggcagattaacaaaactgaagttaatcagagatagtcttatcatttgggctagcactatcaagaaaaagacacctgcttctggaataagcaaaaaaaaaaaaaaaaaaaaacacaagctacatctggcctttggtcatcatgtcgagtgaacctgcctaagaatgaaatcttacagggaaacagaggcagtctcaatgatactgcagaaggggaagatatcccatgaattgagaaatatttcctgggtttctactcgattgaaattccaagaggtaagggatagatactgccaggaagacttgggaattcaaaagaggagctctctgagactagagtcacatcctgacacggctcttctccaatgtgctggagtcctcagcatctgctggtcttgattcactgatgggggcaaccagtgtccccttaagtgtccgggcagaaacatactgtaccttggttttagaaagtaggttggcaggcatctttcctcattcccatcaaggagttggtaccttccacagtgtaagttattttctctgttctagagctactacaaagtgctagggaaggaaaatctcctaaagcagtctgtcatcatgaaggccaaattatgtagcagaagagcttggaaaaagattaagacggtggtggggaggacctttgtcctggtggcttgaagccatagggaaagaggttcactaaatgccaacaaatgctaaaaaataaaaaaatagacaaaacagcgagccagtggcttgtgctctgctttccacctgaaagtttgcccaacataagcaattataatcaagtagaaattgaagcatatgtttaagcagagaggaccaggtaacattgataaccactgtcctcccagccactgccttaattaggctttcatgagttttcacccacattattgcaatagtcaatctccctgcctctgatcctattatactctactttatcctccacattgacacctgagttacttctctaccttgtaaaaacaatttatttctgagtacaaaaacactacatgttcattgtaaaatactaagaaaatacaaaaaagcacacataccagaacatgcaattctatcatctagagatatccactgttgacattttagtacaaacctttacacagttgttttctctgtgtatttttaaatgagaatgccactgttgtatttagcatgctttttaaaattttttatttatttttatttttcaatccaccagtaagatatcccggagcatgcttttttttttttttaaacttagtatatgtgagcattttctcatggaattaaatgccctctacaatattatatataattaatatatcaatttacttaagacaggtgttgcaaactggcagcctatagccaaatgtgatatatgaacatgctatatactttgtcattacagcatttcagagttgtttgacttttgaatgcctttatacaatgcatgctgtcttcaattctctacagtttccataaattcctattatgcccagtccttattcactcatgtcacctatctttttttgttgttgttactgtttcggtgtgggcttttaagaaatttttgacatttgagttgaaaacagcaatttagccagaataagcatggatgttcattcacttagtatttgttgcctacctgctacataccaggcactgggttaggtgagaaaatggttagcaaaacaaacacggttctttctatcttgaagcttatggtctagcatgagagacacacaaatgaaataactgctgcaagggaaacctgagctagaaacttttgttttgttttggggcttccctgaggaagtaatatgtgaacagagatctatagtaggaaataggccaaaaagcagagaagaatcttcctagccaaaggaatgtatatgcaaaaggcctaaaaaaggaggtatcaaactgtgccaaaagagctgaaacactgaaagtgagaatgtttgcaagatgaggctggagaagtaagtggaagacagatgattcagggcctgtggaccatgctaagggttttgagatacatgttgataaagaatctaccctagtcttcttttccttagggaaacatccttctctttttaatcactccttatatggcatgatttcgaaatccccttcaccctcttactacccttctctagcattaataattttcttagtccactgctctggaaccagagcccagtaaaaattagttaagctgaaggctggggatggcagtctagcacaaatagtaattaactactgggcacattagtagaacagagctgctacctaaataaatccatttaaagtcaactaaatgttatttgggtaatatgtccctcatgttaaatttgcccaaatatatatctcacctcttaaaattcgtttagtttgaaattaaaattagtattgtttttctgcatgtactcctaggttgggtaaagaagggaacaagggaatggggaaacgtagagattcctggataacagagaaagacagcttgagaataaaagtatgcaaaagataatctacaacaaaataatgcacttaactcttgttactaaacaaataagctacccacattttagttttctgttttgttttatgtttgtcagtttagcaatttttgtcactgtttggaagacttagagtggttattgcatagaacaactccttacacagagatttgcaagtttctgaattttgtactttcaaattgaaaatcaggagaaacattttcaaggttcatattcagaccaagttagtatattaacaactaataacaatattaaaagttagaacaattcctttcctctatctttctcaggacaaatcgagtttattagaaaactagggagtgatctggtgaaactggaaagaatccaaggagttccagggaaatctttcattcattcatttgtagattattccacaaatgtttattaagtatctatggtatttatacagcacctacagtactatttagggcactgggtatagcttacaaactgcttaactctgaatatcttttgtgcaaggaataagtagtataatagtcccttgaaatacaggaattcacctagagatcttctcagatcctcagatgtgcacgttttatatcatgtaacttaatccagaaaataaagcataagcaaactgatatttttacacagcaatgaattttgaaagcaggcagagcttctagtctcatataaggggcttagaacttgccactgcatcctaataacaagtaaaaagctgaacaaacaaaaatcaacaactcttcttaacttcatcagaaatgaggacacagggaaaactgctgccctcaaaattggagagacagataggaagatacaggaaatcataaccagagcagaaacctctgggaaccagtgctggggtaggaaaacctgaactgtaattgatgaaatgctgaaggctcactgtggacaagcctgagagtcaaaaactccagggaaacccagtcatagaggagccct

SEQ ID NO: 887 - DNA, 5082 bp, Homo sapiens
gtcaagcgtgcggcggcggccgtggaagggaactccctccactagaatatgagctccttgtggtcaagactgggtcccctgttcccttccccccagtgccagcggagcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggcattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaatctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcacagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccaagaatgcaggctggttccgctgggcacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcacaggtgctccagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaaccctggatgatttttgtatttttagtagaggcagggtttcaccatgtttgtcaggctggtctcgaactcctgacctcgtgatcctcctgcctcggcctcccaaagtgctgggattacaggcgtgagccatcatgcccagccaactggtttgtgattaaatgttttgattgatgcagtttttgaaatgtactgtgtgtacaatattactcttttgagacagggtctcactctgtcacctaggctggagcacagtggtgcagtcatggcccactgcagcctctgccttgtagcctcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaaccttcagtccggtcgaaggtgtggtgggggtaacaacagcaggctcatggatacctgggcagtgctccgaggtccctcctgtgttcccactgagcagcagcctgctgtgcccggagtggaggtgagaaatccagcagcagcgcggtggtgagtgtgggccctgcggagtgtggcaggcgctcattatggtgcagggcagtgttgggcacagagaaggttctcagaaaccacagtaacccatggttagttggtcacatcccagaccctgacctagcactggctggcactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccaggggaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcggagctcatcctccctggctgtgctggtgtctgtccagtgggattagcctccatcctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgataaaccccagagcagtatggcctgtgtcagaatgaccagtaggagggccccggggtagcagctgcccagcccagctgcgtgtgtgtgtgaagtattttcctcaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccccagtagccccttcacaccacaccgcagtgaggatgccctgtctcctgccgatcccatcacaccaagccttttcgctgttgggctcctggcactgcccgatcctggagggcacttggctgcggctgtggctgtgaagggctggtgctctaggcgcctccgtggcccccgttgcctgggcacctacttcctgcctcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcacttcaagggggccctgcccttcccctcccaccaccccaccagggtccccatcttcccctttgtctcctaaagcccgtgaggcagtagaggagccaggccctcccctgccacaccctggagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcg

SEQ ID NO: 888 - DNA, 3591 bp, Homo sapiens
agtctggtcttgtggggtttaggggctggaaatggggaagagctagagcacagcatttaggattgagttttatactattcggtactccaattatgaaaacaacgatgatgatgcttctgacctgccctgttgggctgtttcttccccatccttttggagaaatttggatacagagacagatgcacacagagggaagatgatgggaagggacacggggagaagatggtcatccccatgccaaggaaggaggcctggaacaaattccccttcacagcactcagaagaaaccagccctgctgacacttcgagttcagacttttagcttccagaactgtgagactatacggttttgttgtttaagacccccggtttgtagtactttgttacagcagtcctagccaatgaatacaggtaactttgggctacttcatgatggcccagatgtctctgatcctgtagtgtggtgccctagcctggtcaacgcttggagttttataaccctccatagcttcagtttcttcatctataaaataatcatggagcgtctactaggtcttgcaattaatctggtaaaacctttttcttcaacaaacaccaataaagaggatcaaaaatagcttgcttttttttcaggctggagagtggcacatatccactgttttatctagggttagttcccaggaatatctcctgttctctgttacaatgaagtccaaagggccttgatcatattgacattccggagagcatcattcagttcctcatattgattgaacttaataagtgggaagtggcaagtagtttggacactgtagtaaaaatacatgtataccagagggagggagctacatcccaaggagattcagatactctccacattggtctagtttttgggtccaacagtctgagtcatgctgagaaatcccatccaaggtaaaggacaagttgtactttgcttctcctaccactaagaacaggcacagcactaaataggcttccttggattctggaggcagcatataccatacttgggactaattctcaacacatttattgagtgactcagaatgcttccagctttcagtgggaccagagcaagagaatctgcagcagattcaggctgtgatgcagtgaaaagtgttctgtcattcaggacatatgactcatcagatcagtagtgctaaagatagctatggcagatacaaattctgtgtggagtctctgccaaggttcaacagaagagtcacatcacagacccaagggttctggagtaaggccatgccatctatggcagagagatagttaccatttgcaaagcagcatctggtgtagttctgggccttagcagaggtgaagtacctgagcatgggacataaaattacagatcatgagatgggtattatcagattcaccacttcatgagatcaggcaatccattgtacaatagaaatggtacatttagacttggatccaagcagacccaaaaggtacaaataagtttacatgaatagattacacagaccttcatgttacctagctctattgcacagattcctcgacctcagttctcacctatgacctcatggagattcccctgcaatcaactgacagaggaaagaaaaatctccagcctggcatagagatggatatctgagtaagtacagctatcacatttcagaaatactcagaggtagtcccaaaggacagtgcaaaaggaaaatcctcccagtcagcaagactttcagcagtgtaattggtcattcagtttaaataaagcaaaaaacagcttgaggtacagacatacacagaacctagagaagtgaaaaatggcttggctggctagtagggatcctgggaagagaaagattgaaagaccagataaaagaaagtttgcgaaagagtcatggaaatgggagcaacacacctgtatctttgaagaggaggcactgaacaggtaggcaggatgagttgtcctatggatctaagccagcatctcctctcagccacctcagtacttgggcaatgggcccatgagtggccattgttgtagggatggtgctatcaatgagcccaagattatggcattcctcttgttatggttcttccagccactggcattcatgaatgcccttcctgacagctacagagactgacactaggcacttgctatggcactattattgtaatgaaaccagccagccacaaggtagcatttattattgatcacgtgattactatattactagaaggggaggtttggatcataatcttgcaagacacagtctggaacgctgtaatcccaaatgttgaaatcacgaaaaatcaaaatccctaaagtctaaaatccctgatgcctaaaattctgaagatcacaatcacagaatagttgcatcatgttagaactattaccttgttgttgtctttatttggaaattaagtacggcttaagaagatgtctatgggtgccaagttaacaaggggcagatttgtgggcttcattttaggtgtcaacttgactggattggaaaatacagagaaacctggtaaagcattatttcgggtgttgctgttcaatcaccagtattgtttgcaccaaatttgtgacctgtatatgaatgcatgcagtatggacttccaagtacccaaaacaacacagaagcatgacacagaatattggacaatttaatagggaacgttcatgtcggtgactcatagaaaaagttcagagccatgccacgtagaaaatgaatatgaatgtattctccaagaagagccatatccaaaaagaaaaatagcagctattcatcatgatgcaagatttcaacatatagttgatgatcgtgaaagttagctaggtcttatgaatgatcgccatgcaaatgcccataatctattcctgtaatatactttttcatatgttaaattttctttttatgttgtttcttttcttttttagctttttttcactactttaaattgtgaacattattttttacaattttttatgctatgtgtttcatcttcgcgtcatttctgatatgggaggtagacattgtgtagagattttttgagagttctaatttgtcttacgcattattacaaacttgacctcataaaagttcattatcacaactttgtgtgtgagcattatgtgtatacataaaaacattgaaactttctcaataaattaagggaccttcttttcgtacatctgcatttgtgaaagatgaaatttctcgaaacctcagctctttgggtaaccccatatgcagtggtgacccatggcgatttttgattgatcttgtcaaaagacttaggttgttcatcacagtacttcagatgaccacaattataaagctgagtgcacacaattaccaaccatagtgacatttgtttatacatttccctttttgacctatttctttaccatacagtttacctactcatacctgttatatctgtgtgactgtcattagcatacctgagtatttatgcttgcaaaaatatgtgtgttattattgtccattttattgcttaaagtggcccatgaaatgttcagatgtgtttttatgtgtttcttaaataaatccc

SEQ ID NO: 889 - DNA, 3616 bp, Homo sapiens
ctgtagaacttctcatcctccgtaactgcatgagccaattctataataaatctcctaatgtatctctatatatatcctattgggtctgtttctctggagaactctaataatatactacctaatcaaattgttgcgaggattaaataaaatgatatatgtcatagtgccaaataacaagccctcaacaaatggccattatctttattactagtgggatttagatcatgtgcttcttactaaaataataaataatatttattgtttgtttcagctatgaaaagaaaacatttggaagatcactgattccttcatggagaggctggcttgggaatagatgacgtgtcaaagattgacatcaaccttgagtgcttatttgtggacttgagatacagataaaaaaaaaaaaaaaaaaacctccctagagtgagggctacttgggatacatgctatatcccaaggagttctcagtttgaggtcagccccagctctacaactcaccaggagagtgcgcgaggatgagggagagacagcctgctctggttctcttcaaggtgacaatgacacctgttgacagatgagaattccagccaggaatacagatttaggaatcatgtttctcactctcatgatgacatagaagagatgcgtctgaatctttctgccagtgtgttaaagttattctgatattgactgtagttctgagctttgtctctatcccaccaaaccactaacttctggaaattacttgtagaccaagatgggaggactccgtgtgtggctccgtgagtatgtctgttacttctcctcttatataattttgaagatagctatttttctctcttggcagatatgaatgacttatcgtgcctgtccagagtcagggaaaggagaaacaatcttatttgagaagggaggatatcactgcagtggttgtgaaatcgtgtttggaagctagattgctctagaccactaaggtatgatttcacagaaattcccaagatccctgcaggggaaataacaaaggtcctgggtggcatggcaacaatagagatgacagaattgggaataatatcaggctaaacctgtcctgggaggcagggaggaaaagcagcagcaagtacaacatttgggacagagagcttgagcttgaacagaatgtaccggtgctgttgggtggcagccaggcccaacaatttagcattgggctttctctcttcatgtgacaaagaaacttcctaaaatactaaaagctaaaggagattgttatctaagcttgagatggaaggttgccagcggaaacttggaggatcacagccagtcgcctgggattgaccacagggagtggcagaggcagaaagcaaaagaccagttgcaattatccaggtaaaagatggaggctgttgcaataatccagtcctttttagaatcctgaattgagcctgtgttcccagttcctagaaaccctcaaggttattggtttcctcctcgcttaatagaccagtggaagaaatctacctccagttctatcttcacatgagcaactgtttacagtttacaatattactctgaaaatcagttcttttcaagttttatctaacacccaccagaagaaacagaagattatgaaaatggaatttgtcaaagttcctctcccaacaatatgatatttaattttgctaacatttttttttgaacacttactatattgcagacaatggtctaagtaaagcattttatgtgcatcctatcatgtcatcatcacacagccctgtgaggtagatactattattattaaccacatttcacattcaaaaaaactgaggcttagagagactaagtaaattgtccaaggtcacacagccatgaagtggcagagctgtggttaaaacctatgtctgtctgatgtttaagattttgctgttagcattactttgaaatgacaatatgagggcattttatgtattttttttgccccaatatgatctgcagaaactatgtattttaagtactacatttcttttatttaccaaattattgtcagataagaaaccgaaataaaagtttacagggtctaggattcctccataatgaatgaactttggggtatttcagtgacaaattggctttaacgcgatcaaattccatcctacaatgaaagtgtgttagtttgtggtttcaagtttaaaaacagcactgtattgtcttccagaaatatataaatagaaattcaagaagtatttcaatgaatacagataaaattagttttgttagaacatcaaatatgtgggtttcatttcttagctcagtttagaaactgtaatttcaattttttttagcagctgtggtaaattttgagatttgaaatttcatataatataaatcctcatttattgagcatttaaattatatgcccaacaatttactgtgtacattacttcacttgttcttaactataactctacaaaatattattgtccttgatttatagatgaagatattgagactcagttaagtaacttgcttgaaattcaaaaacgttaactgtggaaggcagtatttgaacccagtgttcaaaaccccatgctctttttattatatgaccttatttcctattcagtcttcagaagatatattgtcttattagattattctcgttctctaaataagtgaccttgggcaactatctttttccctggtattttcccctgcctttaaaacaatgtgatcaaactggaagtttttcacgatctctcttagccctaaagctccttggttctgtaattccaccaatagcccatttcaaaaataattctacagtaatcagtgggactcctgtttttcccatcttttttttttttgaaacagaaaattgaaacttttaaattagtttagtaaatacatctactagtttttttcttttatagtcatggttatattatttggtccttcttagttgcaacatgtttccttgctgtcaatttataatacctctcatcaacaatagcctgaagaaatagatttgaattgctttccctaatttatagctggaaaactaggctacgctggtatcttaaattgactttcctgaggtcacgggcactcagtgccaagaggagttggtacctacgcatttgaaatttctggatttctggtcttactctgtacttagtcactcttttctttcatttggccctatggtgggcaaactacagcctacaggccaattccagcctaccatctgtttttgtatggtccatgaactaagaatggttatcacattttaaaatggtgggaaaaaaagactattttgtgacataaaaattatatgaaatccaaatttcagtgtctataaattttgttggaatatagttaccacactcattcttttatgcactgtttttggctggttttctgcctcaacagcagagttgagtaggtgcaaccaagactgtatggcctacaaagcctaaaagtttgttatagaaaagtttgctgaccaactctattggttgcttagtattgctaggcactctgcaagtcacagggaacacagcaaactagacacatgactgccttgggcttaagaagaggtttctaaacttttgaataaaaaaca

SEQ ID NO: 890 - DNA, 1605 bp, Homo sapiens
gaaattgttattcccattttacaaaggaagaaactgaggctcaggggtttacataagttgcccaagatgatataactagtaaggacacagctaggagtaaaacccaggcctgcagaggtcctatagacataatctttgcattacacagagccctggccacagctacctcctagtcctaatgttctgcaagtcttgctttttaagctctgtttttgttttggttttggtttgttttttgggttttttttagacagagtcttgctctattgcccaggctggagtgcagtcattttactatcctcttttgttaagtgtctgttcaagtattttgcctgtttatctactgggctgcctgcctttttcttactgatttgtaagagacttttgtttttttaaaaaagtctggagaccagttctctggtggttttgtgttgtgaatatcttctttggtattcacgcacatctctttaaagctcacaacaactccgagaaataaatactttaatgtctatgaacagaacaatcttagagaagttgggtggcttgttcaaggtcactgagctagttagcacaagaggtgggaaatcaaactcagatctgctcagcttgaaagactggctcttaagcattcagccatactgggaacagaggtcatccatccctctctagcgctatatgggtcttcagccccttctcctgcacctgcttctctcttctctccttgtttccttgtgactttaacttacgacttccatttcctgccctctccttgtgtggcctttcttctgactccccagctccaaacattgccactcacttgggttctccttcaaactccatgaaggacatctcatcagctccatttggcactgccccttcatgggcaggctttcactccagaccacgttatggccacggctcaggtactttcccactccaatcagctgtggccagggtggcagaatcccatggtcagcctgcctttgatagagctgcgggtttataacataaaggggtattttatttaaaatataaagagctttcacaattcattaagagaaaggtgaacactctaaaagaaaggtaggcaatttacaaaaaaatgaaatacaaatcatcaataagcagagatacaactgaaacaagctggagatgaaattctctcctcagactgaaagatgaaaaagaatcatccatacagcacctatgaggccatgaggaaatgggaattctcatacaccctggcaaagtttggcaatttcaaaattgtaaatgtgcatccactttgacttggcaattccatttacagaaaagcatcctaaagaaataatcataggctgggcactgtggctcaaacctgtaatcccagcactttgggaggctgaggtaggtggattacctggggtcaggagttagaggctagcctggccaacatggtgaaaccctgtctctactaaaattacaaaaaaataaaaaataaaaaattagccagacgtggtggcaggcacttgtagtcccagctacttgggaggctgaggcaggggaacagcttgaacccaggaagcggaggttgcagtgagcctgggcaacagaacaagactccat

SEQ ID NO: 891 - DNA, 5756 bp, Homo sapiens
agagtgtcctgcttcctccgagagcttagctggggagaagagctgggagcgactcgagctgaggacgtggaaggggtgagtgctaattcctcagggcccgcggggcccacccccgggcccacccccaatcctacccccgccaggcccttcccccgtgggcgccggcagctccaggcccagcccagggcgtccaacgcggagggggtgcaggagttctcctgggcctgacagcctcagccgtgcagaaacccggcctagggagggcatgcaaagaaggacgccagagaaaaaggtcgagacaagccccagaccccaggaagtgactgtttgggggaagggaggatttccttcccaaggaaaaggggacagatgaggaatgcacttcgcgtccacgccgccctggtcagggagccgcctagagtcccggcttcggcccagtctctcctgctccctcccttagcgtcccgcggtgcccgggcctcttggcgcctggcacccctcgtctcgggtactcacagagtccggggctgcccgtcgtcttccatcatgcccgctccggacactgcgctccaaccaggaggagcaggaggaggaggaggatgaacaaaatggccgccgccaccagccaggcaggaaacagggcagagcgcaggcgcgacccgccaggtcaccgctcaggccagccgcgacagcctgcaagggggacgaccgaggggagagaaaaaagggccgccgaggaaaccctgggacccgctcacgacggatcacgtcgtcgctgtgggcctctggccggccgaagcccagccagctccgggagagatcgggcaaaaagagaaacgtcgtgaagccgaagtctctgggaattgtggtcctggaaatgagagagggaagcacttctgcagaggacttctggaacctgtggttaagaggagccgccggcgcccacccgcgctgggacgtgaagaggagacttctgggtagtgtagtcatacgtgaggacgtgcgacgaccaggaagtcggcgggctgggaggtaaagggaagaataaaagcgacattgaaaggcggggagaccaagtggggaaaagcgctgtctgggaaagcgaactacaagtcccagagttcctcgcgccgggggctgtcctcggactgctccaggcattgtaaggctcttctgttggcccagtctgagctgctgctccgccttcgtccagcccgagagcggtttcttcaactgtggctcaggcagcactctccctccgcgtggtgtccgagccagcagggccgtccggccctcctgtgttcatcagaacggctggctcgcgttagtcaaccgccgcttcgcgcgacagtcagaagagaggctgtgctggcggggacccggaggggttggggtgttttggggactcgatttcccacaaataggtatttctagcctatttgttaaatacaagtaggtggcctgcttgtaaattgctttacaagtttcagaggtttccctatcaaatgtctcatcggatagtggggtaagaagaggagccctattataatgacttgcccaactccccccgtattcttggagttaaaagaaaaaaaaatccttgggcagagacgtgcacaaacataaagttgcgtttacagacatcagtcatgtgggctagaaacgcagttttgcatgaagataggggaagccatgttcatactagctctgcatccctgtagaatttgtcttctcaccccccacaacagttcctggtgtgcttttttcctcctctaagtaccttcaggagaaagtacttggtcttgtagcttagtgaagagtggcgatgaagaaagatctttcagcccattgccagaacttaactgccccggttagtaatggcttaagagttgcttctgccgacatgtactaagtgcatgtcgacctctgcaagtggcggtgcgtatgcgtgccactgaacattaatcttgaaagcagaatcaaccatgcagcaagcccttatgttgtccattttcaggggaggaaatttcaacctgaaagacttcatagagacacggcaaaggagttgagccccataagagtccgtaggaacaacaaaaggctcagacgccaggacccatggctaaaatgtatgggctggggatgcgggcgggagcggggggaagggaactaaagctagagaggaccttgtagaaccgtgttgtcaagaatctatttcatgctgaggaatttgagctttctcttccaggcagtgaggagccactcaaaggttttgtctatgtttttaattggacctaggtgtagaactggatttaattataatccaattcattaacccatgcctggcccgctgtgatagtttcctgttgatgctgtaacaaattactgcaaatttagatacttaaaacaacacgaatttattttcttacaattctggaagtcagaagtccaaaatcagttacactgggctaaaatcaaggtgtcggcagggctggttccttgccttttccagcttctagaggctgcctgcattccttggctcttggccccatcctccatcttcaagaaaagaagcatagtatcttctttcttctctgcctctgtacgtacatcgtgattctcctgccaccccttttcatttacgagaaccttttgtgattactttgggcgaagattatctcaagattcttaatcacatctgcaaagtcccttttagcataacattcccaaattctgggaattaggacatagaaatctttggtggaccattattcagtttaccgcacccacctttattactttagttttgattatagccacaaacccaccacactaaaaagttataatgacacgagtttatatctgtatctatgctatacctcctacacacaataacacacacccctgccttcgcttggggtaaccatctttctgaatcctgtctttactatttattgctttccttctacaaggttttattccacatgtacatagtcctaaaaatcatatgtatatacatgtatatttgagtttttttttaacttagtaaaaagaatatgcccactacaaactagaatggttaaaatgggcatgtttactggcagtgaaattattaaggttaaaatccaaaacactaacaccaccaagtgctggtgagtatgaaaagcaacaggaactatcattctttgctggtaggactgcaaaatgttatagcccctttggaggacagcttgtcagttccttacaaaactaaacataatgcctaggtacttacccaaatgagctgaaaacatgtttacataaaaacctgcacacaaatgtttacagcagctttgttcataatcatcccaaattggaagcaactaagatgtccttgatataagtgaatggataaactgtcgtacaaggtggtacatccatgcaaagaaatattgttcagtgatttttttaaaaagagctattgatatggtttggctctgtatccccacccaatctgatcttgaattgtactcccataattcccacgtgttgtgggagggacctggtgggagataatttgaatcctgggggcagtttcccccagactgttcttgtggtagtgaataagtctcacgagatctgatggttttatcaggggtttccgcttttgcatcatcctcattttctcttgctgccaccatgattctgaggccttcccagccatgtggaactctaagtccaattaaacctctttttcttcccagtctggggtatgtctttatcagcagtgtgaaaacagactaatacagctctcaagctacaaaaagacatggaggaatgttaaatgtacagcaccaagagaagcccagtggaaaaggctgtaaacgctacaactttaactatatgacactctggaaagggcaaaactcagtggttccctgggcatcagggaaggagagagggatgaataggtggaacacaggtcatttttactggtagtgaaattattcagtatgatactctcatagtggatacatgaccttatgcatttgtcaaaacccatagaactgtgccacacaaagtgagtcctaatgtaaactatggacttcagttaatcataatgtatcaatagttgttcctcagttgtacatttgttggaattgatgaaccaatattgatacattgtgattaactgaagtttatatatcaattatgaattgatatacttgttaacactaatataaaacagtaataacaggggaaactatgtttgtaatgggagagagggcacatgggaactctgtacttcatgcacaatttttctataaacctaatactgctctcaaaagtctattacaaaggaaaaaattatgtccttgtaatcttttgagactgcttttcacttaattaacacacataagattcagccatattttatggctatcattcattcagactattatatgatattccagtgtataaatatactacatttgtctgatttctcattaatggatatttgggttgcttccaggtttttatactgtgaataatgctgctatgaacattcttttttttttttttaacctttctttatttttatttttttttttgtttttgagatggagtcttgctctgtcatccatctagagtgcagtggtgcaatctcggctcactgcaacctccgcctcccgcattcaagcgattctcctgcctcagcctcctgagtagctgagactacaggtgcccgccaccactcctggctaatttttgtatttttagtaaagacgaggtttcaccatgttgcccagggtggtcttgaactcctgacctcaggtgatccacccgccttggcctcccaaagtgctgggattacaggtgtgagccaccacgcccagccagctatgaacattcttgtgtctcctgtgatagatgtggaagagcctttcacccctcagccattagaccaccagggagtgcaagagcttttctttgatctatttggatctatacctaaaagtgaaattgtcaggtaacagggtatatgaacactccattttggtgggtaacatcaaacctttttcccaaagtgaatacacaaatttgtactcccatcagcatcgtttaagagactctgtgagcggatccacattttcttcagtacttagttttgtagtctgacaatcaaagtattagctcaatgtggtcttaatttttacttaatcaataaagttgaacatctcctcatattctgttaaccataagtttcctcttctgaagcatgcccattgatatcttttgcctatttttctattatgttatatgtgcttttctcaattttttaggaatttttgatgctaattctttgttatatatgtatattacaaatatcttctcctagtttgtaacttgtccctctctttttaaaatgcttttgatgccaggcatggtggctcacacctgtaatcccagcagtttgggaggctgaggcaggtggatcacctgaggtcaggagttcgagaccagcctggccaatatggtgaaacctcgtctctacaaaaatgagccaggagtggtggcatgtgcctgtaatcccagctacttgggtggctgaggtaggagaatcgcttgaacctgggaggcagaggttgcagtgagccaacatcgctccactgcactccagcctgggcgacagagcaagactccatctcaaaataaataaaataaaatggttttgatgaacaaaagcttttaattttaaaatggtcaaatatctt

SEQ ID NO: 892 - DNA, 3273 bp, Homo sapiens
aaaaaaaaaaaaaaaaaaaatcaaaatctatataattaagcattgttttttaaaaagtagtttaggaagatttgtaaagcttatgaaccattgtaaaaccttatttctaaggtctgtaagacagttttatatgtaataatgtgtccatttccaggaattccccaaatactcatacagccattgagcaccccaatccaaaattcagaatgcttcagataagaacatttttgagtgccgatgtgacactttaaaggaaatgttcattggagcattttgcatttcagatttttggattaggaaaactcaaccactgtatttctgcacatattccaaaatctgaaaaagtctgaaacctgagaaactctggtcccaagcattttggaaagggtatactcaatctgtattaacatagacttctaaattagtgaaaatttgcattgaattaaaatgtgaagtaaatatttttgtttaaatattgtttaaaatttagtcatttaaaaattttgtgatgtaacaaaatgttgaatgaaataatgcttctacaacttaaaattatttttcatagtgaacaaaactagttgaatacttctaaatattcatttttgttagtgcacattttatccagttttaggctttagggaattgtgaccctttttttttttttttttttttttttggagacggagtcttgctctctcgcccaggctggagtgtgtggcgcaatctcagctcactgcaacctctgattcctgggttcaagcaattctcatgtctcagcctccctaatagctaggattaccggtgcccgccaccacgcccagctaattttttaaatttttaatggagacagggtttcaccatgttggccaggctggtcttaaactcctgacctcaggtgatccacccaccttggcctcccaaagtgctgggattacaggcttaagccaccgtgcccggcacttttgtttttaaaataatatcttactttcatatgattctttcagactgtggtatggcattctgaagcaagtcttaacagagctaaaaatcacccttacccaattctctgcactgacatatgtacacaaagtaatattttattattctccttcataaatggtttctttaattgaacctttgagccttatactatttttaaatttccctttaaaaattgaattacagccaggcatggtggctcatgcctgtaatcccagaactttgggaggccatggcaggaggattgcttgaacccaggagttgtagaccagcctgggcaagatagcgagatcctgcctctgaaaaaatcataataatactttaatttagaaaataccctgaattagaagtgcttcattcctcatttgtgtacagctgttcctctatatacgaaggggattggtaccagaaccactgcataccaaattccacccatactcaagtctcacagtcttccctgcagaatccaagtatacaaaaagtaggcctatcatttatatgggttttgcatcctgacagtactgtattttcaatcctagtttgtttgggaaaaaaaaattgtttgtatgcctgggtacagtatcatacctgtaatcccagcactttggaaggctgaggcgggaggactgttttgtggccaggagttcaaaatcagcctggtcgacgtagtgagaccccatctctacaaaagaaaaattagctgggcatgtggcacctgcctgtggtcccagctactcaggaggctgtgaggcaggagaattgcttgagcctgggaggttgaggctgcagtgagccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcagcattttgtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggtgaaaattttagaccaaaccatgtctttctgggttgtagtgattaaaaaatggttaagagaatgttccctatacaaggcatatgttattaaacatgaaatttaggattagttttctctttgaaaattcttttgatatgctgaggttacagtttggaggttacattagagaaagaatatagggaagatggcagtggtaaaacatttccctgctttacatttttatattggcagtatcttggtttcaacttttctattttcagcaagatatttgcaagtttttactttgaagatgtttggtttatagtagtccatgctatactaatgctgttgctgagataattaagttagatactaatatgaaaaagaatatttgtgtaaaatattttgaagttgtaattagtgtatatacaagttgttaatacttacgaaaaaaggaagcattcccacctgtaataattttgttaacactagactatcagtaaattatcaagaataaaaaccttggtttttctgtaatatttgccactgagcaatttttattaaaaaccaaacagaagtatttacacaagaacaagtgaaattacacaaaatgataatggggagaaatttctcatctggtgataaagggaaaaagataatgtaaaagcagattgctgctatttgcataataagcacttgttgaagaataaatgattaagttcaatatttttgctctattttatacctactcactttggtggaattagttctccatgtaaagtatctttttaatagtaagcaccatttaataatgaaacaactcatatgttttgtaatccttatggagaattacttcatgtgataattatagtctcttcatggaaaacagtaaaaatactcacgtttatgatgatgggcctaggtactaaattcctcattcaatctttttttaccaaatggtacttaataaaatcttttaccttataaaaatctattttcggccaggcgtgagacactgtgcccagcctgtcagagcttttgagtagaaatacggtatcagaaatgtgctttattttattttattagacaaagtctt

SEQ ID NO: 893 - DNA, 7113 bp, Homo sapiens
gcacagctccagagagcttcgagggccaagtctgcagtttggttgcttcctcctgaaatcaacgtgggagtcttaaaagcacggggagaatagtctactcagcagggagcatttcgggatgatgcagccattcataggaagcatggagaggcttgaactggaccatgtggtgctggagaggccattgcactgactggcaagagaagacctgcttcaccgtggtccacacagtaatttccctggcttcactcaaggctaactgtcctccagcaaaacacccctcttttcctctcacagatgaagcagatgagtaaaactgaggctccgtaaggtactcatccgaaatcaggcagaagagttctggtggctggaagtctgaaatcaagttgttggcagtgccagctccttctgaagcctctagggcttctctgaaagaggtcaagaaagcccctgcctctcgcctctgcagatagccatccagtcccagaggaagcggctatttatgcagcaattatcattcaagcaaagccatctttattgcaaagaatggagacctctgtaatatagcacaggaataatgaatgcatctggtctgtgtggcagaggggctgtgactgaaagcacaccatcaggcaatgctgtagaagcgggaatctgatacaacctggtttaatgagaactggagatcatgatctcctggacagccagaactatgttttatttatctgtttgtggccagtttccagccctgggcctggccttgagcaagcccttgagttgaaatgatttaaatcagagatggcacagataataaaaacaggaatggatatggagatagaggatgagaatttgggtattaacttggttatttactaattggagggattgaggtaagttgcttcattctgagtctcacttctcaaatttgtacagtgatgaagtttgggattggagtatatgtggagaggaacctccaaaacctttaccgtgcttcaacattctaacttaagcttaaacgaaaaattgaatttttacctggaaagaaaaaaaatactgttcagaatcctgtgttaatagttgttggtattaataaacaagtaaataaagtaaatacatgcattaggttttatttaccctcctacagtggaagataatcatttgttagttcaagccctgaggcattaccttcgtgacagctggtgaggtacgtgtgtaaaattgaaacatttttatgaaaaatcctaacaaagcattgctgtgtgtgcctattattttaatgtgaactaacagccttattcgagcaatttgtcacatttgaaaatataaactggaccccttattcatgcattttctgaagatgctgctttggtgctgacatttgttggtgcccttggtcataggagtgtgtgtggacccattcatattctcttctgatttagatcagtgggcaagaaggtcttacacacagttacagatctttcatatgccctttgtgttctcaattatgtaggggattttgactggctagctgcaatcagtctgtgagaaagatgaaagaaaatgaccatgaccatcacacactggagtaattgggtgtcttccctgcctcctggtgatgaccaaggacggttcccatcaaaaacacctaaattcaaagaagtcagcagtctgctgaatggagtcccgggatcaggttacatcaaactccagcttccaacgtacatttcaaatatgaaacataaacaccgattgcaaatctgaagacattttcatttagccctaggccaggatttttaatttaaaaaaaataaacctgtcaaggtctgcaggaaaggctcttagatattctggccaatggtttatttaaaaatccaataatgcaatttccttagcagcaggaggcaagagaccttctctaagctgaatgtcccataactggatggtagccagattcccagtacgtgaaacagaagtccatgaaacagaaacacattcccagtacattaaacccctttataaaaggggtgctaccttgaaggcccaggacaggatattctgaatgccatttctccccagaataactatgtatattgggagcaagaagacctggtaatcgaatctcacttactatccatgtgaacttgaccattcacatggattatttatgtatttattttactattaatttatttttgatttttttactttaagtctggggatacatgtgcagaatgtgctggtttgttacctaggtatacatgggtcatggtggtttgctgcatctatcaacccgtcacctaggttttaagccccacttgcattagctgtttgccctgatgctccctctctcctcaccaccccccaacagtttctggaatgtgttgttgccctccctgtgtccatgtgttctcattcttcaacccccacttatgagtaagaacatgcagtgtttggttttctgtttttctgattgtttgctgaggatgatggcttccagcttcatccatgtccctgcaaaggacatgatctcatccctttttctggctgcatagaattccatggtgtatgtgtaccatattttcttatccagtctatcattgatggcatttggattggttccatgtctttgctattgtgaataatgctgcaataaacatatgtgtgcatgtatctttataatagaatgatttatattccttggggtgtatacccagtaatgaaatcactaggtcaaatggtatttctggttctagatccttgaggaatcaccacattgtcttccacaatggttgaactaatttacattctcaccaacaatgtaaaagtgttcctatttctccacagcctctccagaatctgttgtttcttgactttttaataatcaccattctgactgacatgagctggtatctcattgtggttttgatttacatttctctaataatcagtgatgttgagctttttaaaatatgtttgttggctgtgtaaatgttttcttttgagaagtgtctgttcatatcctttgcccactttttgatgaggttgtttgttttttttcttgtaaattcgttccttgtaaattctggatataacacctttgtccaaagggtagattgcaaaaatttcctcccattttgtaggttgcctattcgctctgcgatagtttcttttgctgtgcagaagctctttagtttaattagatcccatttgtcaattttagcttttgttgcaattgcttttggtgatttcgtcataaaatctttgcccatgcctatatcctaaatggtattacctaggttttcttctagggtttttatggttttgagatttacatttaagtctttactccatcttgagttaatttttgtataaggtgtaaggaaggggtccagttttagttttctgcatatggctagccagttttcccagcaccacttattaaatagggaatcttctccccattgcctgtttttgtcaggtttgttgaagatcaaatggttgtagatgtgtggtcttatttctgaggtctctattctgttccattggtctatatgtctgtttgataccagtgccatgctgttttggttattatagccttgtagtatagtttgaagtctggtagcatgatgccttcagcatcgttctttttgtttaggattgtcttggctatgtgggctcttttttggttccatatgaattttaaagtgttttttttttctaattctgtgaagggtgtcaatggtagtttgatgggaatagcattgaatttataaattacattgagcagtatcaccatttcacaatattgattgtttctatccatgagggtggaatgtttttccatttgtttgtgtcctcttttatttccttgagcagtgggttgtagttttccttgaagaggttcttcacatctcttgttagccatattcctaggtattttattctctttgtagcaattgtgaatgggagttcattcattcacatggattatttaaataaaaaacttaaattttaaaccccaaatttaaaatgtgtcatataactgctagcaatctcccaactttggttgcttatagaccaagagtagagaaagagtctatgtattgtctagccctgccctgttggtcagaactggcccagagaagcaccactgactatttggagcaatcaaacttcctctctctagaatttaaaatcactaaccagaaaaagggactcagccatgggcactgaagctataagagccaatgatctcaagggtcaaaacacattttggagtagctatgacggactatggttaatctaaagaaactggttcttagacaagagactagcacatatggatatgcagaagcaggaatgggaggctatgtaagcccaaagagcaagagagaggatgcagacatctgataatattctagttcctatgtggtctggaagttgagttcatgagagtttctgccttccattgtcttgaatttctctgagtaaaattttattcctggaaagcaactacaagagaatgtcataactttttatctgagcaaactttaggtatctcttgtcttaccaaataattgaattcacaaatacttattgaacatgctttatgaaacaggatctatgatgaaagctgatgaaaaagcaatgaacaagatgggtacattttctgatttcatagatctcgtattttaatgggaggataaaaagaccaaaataagataggaaaacaaaacccatatgtacataagtaagtacaggttgacacattaacaaataaaaaattaaaaacaaatgaaaagacaaaacatgttttcagttcaaagacttagtagtgttaagactgatctatagatcaagatttaaggcaatccttatcaaaatttcactggacttttttacagaaattgacaagctgatcttaaaatacatactgaaatgcaagtgactcagcatagcaaaacaatcttgaaagacaaaaaaaaaaatctagagaactcaatgttctaaattttaaaactgaacacaaactgacagtaatcaggcataaggatacaaatatagataaatggatagagagcccagaaataaaccatcatatttttggatagttgatgtttgacaaaggtgccaggacaattcagtaggggaaagcaatagttctttcaacaaatggtgctaagatgactgaatatctacattgaaaggaatgaagctgggcctcttcctctcgccatacacataaattaaccaaaatagatcatagccataatataagaactaaaaccacaaaactcttagaaaaaacataggaataaatctttgtgaccttagattagtcaataatttcttaaacacaacattaaaggcacaagtgacaaaataaattgtatttcatcaaaactaaaaccctttacgcttccaaggacaccatgaagaatgtgaagagacaatttgcagaatggagaaaatatttgcacatcatacatttgataagggatttgtatctggaatacataaggaacgcttacaattcaattattaaaagacaatccaatttaaaagtgggtgaaagatacaaatttacatttctccaatgaagatatacaaatggccaataagcacaagaaaagatgctcaacataattaaccattaaataaatgcaaattaaaaccaaaatgagatatcacttcacacactctaggatgtttatagttaaaaaagatagtaaatgctggcaaatatgtggagaaattgaaatcctcacacactgctgttggaaatgtacaatggtacagtcactttggaaaatagtctaaccgttcctcaaaatgatggagaaaatgaggagtgagttctaataggtatgggcttcctttgggggtgatgaaaatgttcttaaattgatcatggtaatggttgcacaaccctgtgcatatactaaaacccattaaattttgtacttaaattgggtgaattgtggaataatattgttaataatatctcaataaatataaatatatttcattaaaaataaaatataggggcaacgtttcttcccttgcaggaacattagcaaaattgagtccccggctatttgtttgaatttgtattattgttgtaaatcatcctaaatagttcttaaccaaccatggactcaaagtgtcatagctacttatatttgtgaaaaaatatattctttaaatggaagggaacatccctacacatgatatctaagagtgaagggacattcttaagtattgttatcaggaatttcagaacacaaagtgaaattttttgccatgcaaaaaattgctttaacgtatatttttttcaaaatcagataaagcattgaacttgatgatgatgatattaccgtatgttaactacttattatgtacccagtctgtgcaaagcactgcataagcattagtttctgtaatccttccaacaaccttcagacatttattttgtttcccttatttttgatggaatgattgaagctcagtcagatgggttagttaacttgtccagtatcacacagttcataggggcagtttgaaatttgaaagccaggaatggttgatttccaaatacattttactgttaatctctaattatgcttttcctttactagtacgtttgtgtttttagtttttctgtttttatattttaagcacataattatgtaactaattatgtgcttaaaagtataaaattaatgcaggtcctttgtagaaatcttgaaaaaatagaagtgtgccataggtgacactgggaataactggagtttgaaatggggaaataaaattgctgataaaattataatatgtgtttgtatttagtactattaaaggatgcttatgacaatgaaatgtacgttataaagcaattgaattgtattagctgtttacatacacagttgacctttcaactgtagggtcatgagtttgaaaagtgggtccacttttacgtggatttttttcagttaagtttacattgaatgtgcttgcctctcctgcttccccttccaactcctccacctgttccatctctgccaccactgagacagcaagaccaactccacctcttcctcctctgtagcttactta

SEQ ID NO: 894 - DNA, 1033 bp, Homo sapiens
agataatggtgtcttgacagaaccagtctggccagagcccagaggatctcactcagatggtcaccaactcaggccctcttcaggaccaagtttggtctgaagcattatggttacctgggcagcaggacacacaaacaactcactgttgtactctcaactctgagaacacaactctagcccaagcccctgagaccgccgtccttagaaaggcctgcttggaaaactggactttggctgacatctaaaaacagctctcagagcgttcccagtcaactgttagccaataaaagtggctcacggtgcactagaaacttcgtgcaaataatatggcttatgctgaacacttgctttccttctggaagtctagactgacagaaggtacatatgtcaccccccccagtaaaaccctggggcactgagcatctactggactttcctggacataaacattgcacaaatattgctgcgttttttgttctggagaaagaaagcactctgtgtgaactcttatcgtagggagagagatacaaatgcctggatacagattcctccagagtccatctgtgtcttttccctttatgaacattgatatcataaatcttagtcatgaatacaaccatatgctaagccctctgagtcttctagcaaatctctgatgatagtggtgaccgtggggatcccaacacagatatagaaaaataaggatgttctttaaaggctacaaaagtacaaccctgtgagcatggggcgctggccctggctcatcctctacccttcagttccctcattccatgtcatgaacttgctgctctggagcatcaacctgtttgtaggcctcaggcacacaaaagtgtggctaaattcctatgccttagcttttgctgcccctctgcctggagcaactctctggccccaattcaaccttgtctttttcctgactaactcttcttcactatgttttagcttaaatgtcatctcctccagaaagccttcattaactccttcattcttgttaggtagtcccactctgtgc

SEQ ID NO: 895 - DNA, 7882 bp, Homo sapiens
gcacacacgcacgcacacacactcgcacacacgcagaggcacgggagggaaagaagccgatgaataattttgctattttttaaaatactggccgccatcatcaagcagcgagcagcagcagaagcgttgaagggagaggaggcatcgggacaggcccctcttaggagaggatttatatctagttggaaaaaaaaagaaagaaaagaaaaagaagaaaaagaagaaaaaaattgtcaagcccccgaactgaaggttacgagcggcccgtcagcagcccacatgtaaccgaactgtcgtgtttcatggctttttgccactccagctgtcaatcaaagcccggaatgtcaaggtagtgaatgaatgatggttgatgatgatgaagaggaggaatctttcagacccgtttttttcttccagtaaaactccgcgaggggtttctgcttcttgaattttttcctcccccctccccccttttttagctttgcccccgcggtatctataatacgatcctctctctttaaagtattgttcaaagaaagcagtgagaaaaatcaagaaaaaaaaatgaatagtttgcaaaaattggacttcctccccccctttcctgaagaactccaagattaaaagtatccttatttgttgctgagttgctcgtcgacatttaagagaaggtgagtaaaaaagaaaagaagatgaaagagaaaagaaaaagttggtctccagaattttatttcaatcgacagttacgcgaattcagtttagccgggaccgggaggtttgagagtgcggcggggtggggaggggaaaaaaacaaaaacgctgcggagcgttttcgactttgcaaagctgttgatgttggtgggtccaagttcccggtgcagcgccgctggctgagaaatttgtactcagtttttactcttctaattattcttaaattcaatttaagaatttaagtttatcgtcgccaataggattattgttgttttaaatgtcttgttcaataagtgccagttacgtttctttttaaaagaaattcctcagtgtccttgataaacctttttttgtaaagatcaacttcatgcggaacctctgccttgcagggtttaaacattcaacattgctaccttctgtttctttttctgtttttatagtgatactgtaaagtgagttagcatctctatagctttcatttagaaaaacttaagtcgcatttttagaaaaatattccttcccttgcagtgtgagtaaaaacaactcagacagattgatgatttctatattttcttttctttctttatcttctttttctttttttcttttcttttctttttttttctttttttttgagacggagtctcgctttgtcgcccaggctggagtgcaatggcgcgatctcggctcactgcaacctccgcctcccgggttcaagcgattctcctgcctcagcctcttgagtagctgggattacaggggcgcgccaccacgcccggctaattttttgtgtctttaatagagacgggggtttcaccatattggccaggctggtctcgaactcctgacctcctgatccacccgccgcggcctctcaaagtgctcgaattacaggcgtgagccatcgcacccggccgatttctatgttttcaaacaattgtaagctaataatgagttgattatctggtgataatcttgggttttacaaaaaaagaaaagtttaaactttattttcatgtgtttttatcagatgcagaaggcatttttaaccttaacgcctttctctgtctctctctttcatattcttaacttcttttgcattttattgaatacattaaagcaaacaacaggaacaatatggttaggtgtaggagggagagagaaatatgacattttaagatattgtcaaaaagtcatatttaacttcaacgacttttagttaaaaaagtgtgagagtgttgaaagtgcattcctactggaggaaatctatgtctttttaaaatttgccagttgtctcaggggagaacccagaatttctttgaacgaaagagatcttactgatctagttgcatgtcacttatgaaactgttagtttaaaatagcagtcctagtgtagtggattacacatgaggagatcaagttggagtcgattcaaggtattggttcttggtcagtctgctgaattcaaaacactattacctttaatcagcaacttgcgggtgttttattaatagagctgaaaaaggctcatctaacatataagaatttcctggtttccctcatccccaattttccagtccaatagaagcgattccaaaggagtagggtacccgcacttactgatttccatcctggtggcattttgctaatgccccattgtcagcgttggcactcccacccaggcttccaggctcatctgctctcccatatttggggtgaaaggaaagtaggtggggcaggcccgggagacaggcacgaaatgggggtcgcaggaggtggcacacacctccgtcaacagtcagctccttctgcccaggctggaaatggttttaacaggcggtaaaatttcatcttgcggtgtcaaattggggtcattttggggttagagttctcagtgtccgagaggagctgtccagctgcgtggggactcattaactgcaaaagatctgtttcagtaaaaacaattcaaagacaatcagaaggctaaagaccctctacaaatcgcattttacaagtgccccagaacaaatatggatggtgaaacctatttcttcagaatcccaaatcagctacttagctctggagtgggggtgggggtactgcataaaaaagaggtgaaaaggaggggaccaagcgggtggggaccagtggaagggggaatcgggcctctcaaatttaagagtctgtttttaatcacctctttcttattgaagcagccccaagagttctgaaaactgctacttttctatttttcattttctttttttgagccaacatggaatgctattataggtaacatttaagatttaaaaggaataattgaattccactatagtcccttaatttgaagggcattggctttatggggagtgtttaatttgaaccaagaatttatgaacccagactctaggtgaatttgcccacactccttaaggagcttgtgtagctgtttctttttcttttccttgaaagttatagcttcttagcacagataacttcaaattcctcagaactgagaagtccaaagtgttaatctgtgtattaaaatcgccaggtttaaatcctttttgtcttcttacaacagttagaacaattgacgccttgctagagaagcaaataagtccaaccttaatcttatctgtaactttatttaatgttttgatttggaatattttggattaagcatatctttaaaaactctgtaaggttaatttttattccgggagggaagttctctttactgattttgaaaaaagacatgaattattactttgattttcaaaaattccttcaggtaaaaggaaaattcaggtttaaaatgagaagctagatatgtgaaatgccagagattttaggataaaaccaagtcaatacttaaaagtaaagtatcatttgaaagaaattttatttcttgcattactgaactgagcaagtaacagtgatcaaaaatatgttattctctctccatctctctctctctctggactccacttctgtcactaggtcttctctttccatccccagcacttttctttgggttctgaatgacacagtgattttttttttttgtagtctagttattttctccaagcgtctcagagtatttctaaattgttattcaaggagtttgatttcagccctgcagaaacagccctgagcccagcatcgctgggacaaaggcagaaggggctatcttctgttcaagacctgctggctgacagttggaatttttgatatatattttatttggcgtttccaataacgtgtttgtctttccctctccaccccttgcagccatctattacttttaaaacatcccttctccataaacatcggctcatccttgtgaactattcttgaccttcccagcagtgtaaccagcagctctgaaagttggcctagaaataattccactggcttccttacctgttaactttactcactcttcctagctgggatcaacagaaggaaggggacttttttgtttgcttttgttgttgttggtggtggtggtggtggtggtggtggtttttggttctttggtccttttcccacttaaactttctataatgatttattctccgcctcctcccattaataacgtttaagcaccccacactttattttttaaataaaatggagtaaaattattatacttttttcctttatgcccccttttcttttatttctcccaattttaggggcttcaccatctcatagaaaggacttcaataaatagccctctagcgctatctggcggggctccaaacacgacgtgcgcttgctctcactgtttcttcctccttcccgcgctctcttctttcctctctttcttcctctctcctgctttttctctcgtctcttccgctcgattgttttcctctttttttctgtcctcctgcggcctcttgtctagttcctacccctacttcagcgcaggcggcttggaaagccccggccagaggctagtaactctcgcaagtgggagatgctctggcgacggatctctcttttctgatccctcctcccccttacccagcgcggatcacacacatcctttgcctttgattagcatcttaaagttgcttagcgtgccgcttaagtcccagcgtctcagctggcggtggtttggagaggcttaaaactgcattcatgaagtttggaggaaagaaatcagacactggaattcagggctaggagcccagctcagttttaggtcagaaggccgagtctcagtgcgagattgaggaagggtcggggcttaacgggggaggtgggggtggcgggggggggaacagcacggcgcggcgcctagcctgcgagatggagtcggagtgggggtgcgagcggtcctccaccgcctctgcccgatccgtacctcacaatggactgctcgagtttgtatctaggcctgtccaggattgtttactccttcaattaatcagctttatctcttttccccctccccccacctccaccaaatctggagaggagtgggaaagaactggaaaactcacagggcaaagagagaaagccaacagtcatagtgcgggaggaggcacgcctgggatgcaatacccaacagtctcctccctgctttcctgcaatttgcaggtcattgtctttcttatttgtagctttttttttttttcttcagtagccggtaaacaatcgaacgccgggtagggaggtcagaggggatggggctgtgggagagattctactcaggctaggtgctttagatttggacctggctgtgtccctactttattaaaattctcatgtggcgcgcgctgtcttctctcttctctctctctctctctcacacacacacgcacatacacacacagcccgagagaaatttccaatctttgagcaaatctcttccatctagtccttgaaacagaggaaaggacatgggacctgaaggagagttatgattgaattttctaaaatttagttttgacattgcaaagtaaaagtgaggaccgtattcccaatacagacccagagggtggttatttcaggtgaggggacctcagcctgtgacgtctatgatcaaccagacaaagaccccttcctaaatctgaagtcccacccccacccgtggcaaacatggaatacaagggaggggaaggatggcacaatagtgggttctgttttccaagaactgccccccacctccattgcagaaggaaaaaaaagcacggttcgggtgtaattaattggggactgttattaggtcatcattagccaaggtacaaataatagcagcacatttttacttaaaattgaccagccccagagtgatagatcgatttggagtataaaaagatgtatcaaaacatcaatgtcgattatttgaaatattgtagtcgaattttttttattgcttcatcggttaagtgtctgaaaatgcagtgttcaaacatatatttatgttgtcaatactgtcagaactgtcagttttactatactggatttgtactatatttcaaatatgctaatttacataaaatgcccaccctaggattccccccctacacccaccccatctctggaaaatccgtgtcagtttcttcaaaggattcagcaatctttgcctaagctaaagtgtgcactacctcttttactcaattttccacatcggattacatgtctttttcaccatctctaactttcaaagagatccttcttcctttctccccaattctgcctactctaacctcttcttcaaaatagtactgaggcacttggaaagcttcgaatttaaatatccacatcccagctccaaatataccattggagtaaaaaaacggaaaaactggacttgagtgtacttggccgcactcgggtaaaccaggcttcaccaggtagacgttctcataccgtaagggtccatcatcaaattacctggcagattgaaatcttccagggaaaatgaatttggaaatgtaaacaccttttctttctttttacttaaaagcctcgatggtagaaaaagaaataatacttataaatgatcggcacgttttaactttaaaagcttttgaactcaagtgaaagacacacgttggaaacagaattgatagttttaattctacccattttcacctggcacatcagatcagtggcaatcatttattttatggggtgtggaggggaaagggatagaaagcggatagaaagctagaatccactgaagtccctgtcctaaaaatctcagagaaattaaagacttattgaaacacaaacattccatcgctccatactctccgtccagatgaattgaaacttataaatccacgctctccccaattttatgttttttatttattttttttcagggtttgataggaaagatacccaagtctgatagggaagacagggccacttctggactagctgtgaggatgtgttttcatttccataacactgaagcactttctgtaaaccttttgatgtacttaaataagtctatttggacatttaaagaagctacacatacaaacatagcttggctttttgccgtcaatcccagcattaaaaaaacattcataatctaactgagaagctctttcatacccatccttctttcaaataagtaaataaataaagaaatagaagtgcaaaccaaagaaagtttccagcgtgcatctgtacgtcttcgtgtgcgagtttataaacaacttccagtcggtacttgggtgttacctccctcctgccacacaccccaaggcagaggcatcgagggatcgcccccagagagctgtgtttacttagcttgttttaaaaaaaatctcgccgccatgtatgacaagtgttactgcaagaaattcatcagccttctacagatacttccagttttgctgtaatgatctgcagaagagaactgccatcactttctcacatcccaaggtgttgcaggaactcagagagaggggagagtggctgaaacgcttaattaccggaggcgaaggaggggcgcgcgggggaccgaaggagaggggagtgaagaaggaaggtcctttaccaggcttgtacctggagaaagctttgaatcgcttctctgctatatttggaaaaggtatgcttgctttttaaaaaaatgcctttagggcaaagtgatacccttgtgtaataattaactcagacaataaaaataattgga

SEQ ID NO: 896 - DNA, 2467 bp, Homo sapiens
ataggggcctctgcagccatggtcatgccaccctgccctggacctgtgacttgccacccacttctaggggttccagtcttgccctcacctccttgccctcctgagctcggaccacagagaaaacctcctacatcccgtccctccgtggggcagcagacatggtactgaaatgtgccacgcattgtctcactatgaattcacgggattctcaaaccacccgagaggcagggtgtttgttcttgctactgccctgtaacagatgcggaaattgattctccgtgaggttgcagagtttaacacaggagattcacgtgcagaatctgggtgtcccaaacttgctgccccgcagtgtcactgcgtgatcatctcagctgctttaaatgccagtggtgggttactgcaccctccagtgtcgcttcttttactgacgggtaaactgaggcaaggagccttgaagtcacagatcaagagtcaagagtaagaggcagggctgggattcgaaccgagtccgagagcccgggacctgctccgccgcttccccacgggcctccggcgcccacttgggggctaaggcgcccccgccgccgggcccctccggacgccgaggccagccgagatcgggccgccggccaggctgctgggcgccgcgcccgtccgcatcacgccgcggtgagtcaccgcgcgccggccccggccccgccccccgcgccaacaaacagcgcgttgctcggcaaccgccaccgccctccagcgcggacctgggttcgagcctcaggccggggtgcgcgctaagagggattttgggactccgtagtcttccctagattaggggttcagatcaggcctgtaatcctggtgggcacggaggtgatggtgaaggagacagctgtggtccaatgaaggtggggagggctgagggtggctctctccaatccagacccaccggggctccccagaagtgggcggtcaggtcaggagatggcggctgggccagagttgcagctgagaggtcgaggccattttcctaagggatttggggagctggcctggcgggagctgtcaggagcgctgtgatgagggcttttttgcatcctccccacccctgccgacctcccaaactagctaacacttaatgagcacgttctatgttctaagcctgttctatgcatgtgtgggcctatgtgtattaactcatgtaatgttcaccatgaagtcgggcgcggcggctcacgcctataatcccagcactttaggaagccgaagcccgtggatcacttgatgtcaggagttcaagaccagcctgggcaaaatggtgaaaccccgtctgtactaaaaatacaaaaattagccgagcgtgatggccagcacctctaatcccagctacttgggagaccgaggcaggagaatcgcttgaacccgggaggcagaggttgcagtgggccaagatcgtgccactgcactccagcctgggtgacaagagtgaaactccgtctcaaaaaataataataataaaaattaaaaatagtgttcaccatggccctctgacgtttcattgacattctcattttacagatggggaaactgagtcaacagagggtcaatgtcctttgccagaggatgcacagccaagctggcatccgggctcccaaacctgtctcaggagggtgcatgcctggccttggcagggccatatctgtgggagtcttcaggcgttgtggggataggtgccaaggctacattgaagtgtgggtaggttatgcaagtgggggatggcgcctggtgggctccttgggggctgtcgacacatgatactgaaggctgtgcactacagaggttgcaccagcacccccctagacttcccatgccatctgagtgcagggagagagtttcccagcaccagcttcagatggcctgaactccgggctccctggcaccccaatagtcaccactgagccgcccacaggacccttaagggagctgcctgaggggccttccggagccccagatcctatggggcggggagaagagtagatactagcatctcagacacggagatggaccagctgcctgggaagtgaccagctttgagtcctgtaagaaatgtccatttggctcacatgaccaagtcaatcactcaaatggttgagttggggagatggctgagttacagggatcctggacagtctaaagccaagaaggtgaggagggcttctcggaggaggtgataccctgggaactgaaggatgctcgggagttggcgaataacaggcaggaccttcctgcgggagaggttgggacaccaggaacttttccaagtggaaggtagaggggacacgtgattggatttaacgggctgtctctggagaatggctagaaggcataaggaaagtcggagaggaccagggaggtggctgttggaatatatttaggccagagatgatggtgacttaaggatacagttggcaga

SEQ ID NO: 897 - DNA, 3218 bp, Homo sapiens
gtaagcaagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatcagatatttcattatagactaatatggtagcagattatttatgcttttaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 898 - DNA, 5605 bp, Homo sapiens
gagatcgcttcctgcagaggaggcaacaggccccgctagcaggtcagggtcccgggcaggcgcaggtgccccccggcctctcaagcagggactgcggcgagctcagacgcggctgacgggcagagactcgcgcttgggctcagtgcgtgtgaagtgggcctcgggctgcggaggagggcagcaccccgtggctcctcgcgctgctgcgagcagggccgcctggcaggggcgggggccggtgggcgggagtgtcggggtaaggccgcggactcctcccatgccgctgagcagtggacagcggggactggagacctccaggtgaggaaggggaacgaagtcaagaaggccacatgtcctggcttccaggcttggtgtcctcagaagcctccagaacgtccatggaacccgcccctgcgcccaccgcctcctgctgtctttccagctgagttccggctgcccctcaccctcggcttcttcactctgcctctccccagccagcgccctgctccccggtcctcaaccaccaccttccacctgcctgggccttcatcgcctccgagctccccttccacaccaaacctggcgtccgttttcctccaggcctgcaccagcacagctgaaggggagagagacccaacctcatccactgggcctcccctcaaccagggccacaacctcaaggggccatgccacctccaacacctatttcccaccttctactctctccacaccctgggacaccacccgcctctctcagctgacgttttccttcttgttttgtgtgcatggtgcttgtgtgagaaagtggacacacagtaagtgcggcttccagatgcgtccgccacctgccctccgtgccacgcgcttccccctacctaggggagcctccaccagacagggaacccacgccttgccacccttctctctccctcccacttcacctgtccgcatcatttctggagccctttctttctggcacgagatgctccagggccctgttgtattctccctgccccagcctgaacccagctatttctgctgcagcctggttcattgtgggagaatgtcatgcagagcccgggatctggctccggatgtgctcattgctactggggtgtcattgcagctggcggagcaagggaacacatctatgtacatgcccacacgcatatgtatacacacagtttcatgggcgtgtttgtctgtttttcttgggcaccacgtgtttactctgatgccaggccaacactacagggctcaacctgttcggaatgaggggcctcctgctttgggagtgaggaacctggctctgattatctcctgtgtaaccagtctctcatccttgcttccaccccaccatatgctacccgctcctcaccctgcgtggcctctgacctccgctggaccaccgaggccccgcccccacaggggcgcctgcctgcctagcacagttgagcaaggagtgaattcccagtgaaatttttttaatttttattttatttatttattttgggtttttttttctttctttctttctttttgagatgggggtctccctgtgttgcccaggctggtctcaaactcctgggctccagcgatcctcccacctcagcctcccaaagtgctgagatcacaggcaggagccactgcggacacagcctgaattgtcaatcatatcactcctgtgcctgaaaccattgacagttcccatcacccgccctctccccagtgtccaggcccctcctcccctccccactatcaagacactggctcctgatgctccccgacaccaccgaattccatcctccaggctttggcccagtggctccatctgcctgggacggtctccccataacctcgtgtagttcaggcctttgcgggtgtcacgtccatggagatgtctccccagccctaaccatccctcccaggtgcctctctgcctgctccgggccctccccctgttgcagtgtgagcactgtgaagcccactcttaaccgctgctccaccagcccagcgtggcaccaggcacacggggtcatcggagaacagctggtgtggctgataggctctgagttctgagtgaggaagatgcaacccagcacagggaccagtgcccagagcaagggatcaggagggacagaaccatcacctgggccagaacaagggcagggtgcgaggaacctgagtggttggacttcaggagagccgggtttccgcaggaaggcttctctgctcggacactcgaggggcagggtggagcatggggcacatccagggctgagggacgatgcagagtcgggggacagtgttctgcacgttggcaggtgaggggtcagaggtggccctcagaatctggcaggcctaatgccagccttcaatgaccacctgaattaaaagtggaaatgagtagcagggagaggaggctgaggcagcagcagggaagcccaaagtgggcagtggccgtttgtcaccagagaccttccagcagctgtgggatgggagaggccccagaaggtccctgcaagcctggcccagggccatggaggagcctcaagaggagtgggcaccacactgcgggccagactgggcagtggcagggctgtaccccagggctctcttgtcccacaggccaccatcagcctggtcagcccatctcagtacagccagggccatgaaggaaggccacacaggaggaccccaggccagtgcccgccctggccatatccaaggggcagggtgcagccccagcacctccagcttatctgtaggtcctctaggtaaggcagggctgtccctggaacttgccccatggcccaggcagaaatcctatttgatggtttatggagggcaaagttgagaggaaggagggagggaaggagcaggggccccgggtgcttactcccaggtcttcactgcagcctggggctgccctctgaagtacacagtccctgggaggcagagacctctgccctgaggacgatgtgaatccaaaggtgcttctcacctccagccagggcccatccctggagataagagacactcagagcccttggtggcccaggggggtctagagccggcctcagacctgccctccctgccccgcctccattcccttcagcccaggcctcttgtatcttttggccctcacctaccaccccgccctctccctggcagagcaaacgcttcccagtaacactcccttctctgcaaggatctcagagatcagcctgtgtccctgagtccagagccacacccggtcagctctgggtccctgagtccagagccatacccggtcagctgtgcccaaccccgggcaagactgagctgggccctggggtggaggcggctgcaccgatactggctccacaccaggccttctctaaaaccccacgggagcgggagatacaattcagatgccccacccccacctgcttctcagcaggaaatggtctaatgtgaaagtaggtcttttaaatccgaattattcaatctgtgcatgtgacaggacccacagctccatctctgtgcgcgccctgggcgccgcgctccagccaggctttgaagggtctcagagctgcaggggacgtttctagatttccagctctggcaggagaggtccctttgtctttccctgggctctgggctcctgcagggcgtctgtcctcctcctaccagcactgtgaggttctccaccacacggccctctgctgtcgtcttcacttgcagtgagatccaggccccaaaggacagagaataaggagggagggagagaggagagcatcgtgatggtgcccagggggtgcagaatgtaggtgatcaagaagaaagccctaattagctcctgcagctttcaaaggaaggggctggtggaggaatgggaccatggcacctctccaaccctcagcacacacctgctgaggcccactgggtgccagggtgggtttagcaccaggctctggccctgaggccaaagcagggcagctctgctcagggggttgagtaggggcctggttcccagcttcatggggagcggccagtgaggaggtgtcaccgcagcagagccaggcacaaagtgagggcaggctgctgtggctggtgaatgagtggctggcagagctgggagggtcactgccctacaaggtcacagacatcatggcccaggaggctggtgtggcaggcagagcgaatgccgggccttgggggcctctgagaggaggctgactgtggccccctggaccccgtcttgcaggtgcggggagttggcctctgtcccccaccaggactcatcccttgttccgaagctccccaccatgcttctcacccccgaccctcctggccaccaacccgtggtcatgaatcatgaattgcacatccttcttgggcacacccgtgcttgcacacccaagctgggtacacacatgcatgtgcacaaacacacatgagctgggtatgtacacatgtgcacacacagtggggaatcggtgtctgctggggggtggaggaggtgatggtgtaagtgagcagatgcattgtgggggcatgtttcctctccctgctagagttggaccagaatccccagagaaaactcacgtggcctcttgtcactctggtgagcagacccaggtgggctgacactcgcagagggaggtgcgtagcttagaccaccagctccagtaaagacctgacaacacccagcccctgcctcccttgcaggccaatggaagaatccaccttcttccttagagtcctttatcacaggctcatctggcctcactgtagaatcccaaaactgcatgcacagagatagaaatcctgactatgtccagtggccctaagtaccacagatgaacctaaaggaagggcttttttttttttttgagacagagtctcactccgttgcccaggctggagtgcagtggcacgatctcggctcactgcaacctctgcctcccgagttcaagcaattctcctgcctcagcctcctgaggagctgggactacaggggcgcaccaccatgcctggctaatttttgtatttttagtagagacggggtttcaccgtgttggccaggctggtctcaaactcctgacctcatgatctgcacacctcggcctcccagagtgctaggattacaggtgttagccacagcacccagccaacgcggggcttttctttctttctttcttttttttttttttttttgagatggagtctcgctgcgttgcccaggctggaatgcagtggcgcaatctcagctcactgcaacctctgcctcctggttcaaccgattctcctgcctcagcctcctgagtagctggaattacaggcacctgccaccacactcagctaattttcgctttttgttttttgtttttttgagacggagtgttgctgtgtcacccagactggagtgcagtggcgcgatctcagctcactgcaagccccgcctcccgggttcacgctattctcctgcctcagcctcctgagtagctgggactacagtcgcccgccaccatgcccggctaattttttttatttttagtagagacagggtttcaccatgttagccaggatggtctcgatctcctgacctcatgatctgccc

SEQ ID NO: 899 - DNA, 1020 bp, Homo sapiens
ccctgttgtccaggctggagtacagtggcgccatcttggctaactgcaacctccacctccccggttcaagcaattctcctacctcagcctcctgagtagctgggactacaggcagccgccaccatgaccagctaatttttttttttacttttagtagagatggggtttcaccatgttagccaggatggtctcgaactcctgaccttgtgatccgcccacctcagcctccctaggtgctgggattacaggcgtgagcaaccacccggccttattgttcttatattaaaacaaaagaacctagaaaaaattgcttggttaaattgtagagaggaagggagggaaggaaaatgaaggcttttcttctttgttctttaaaagtccaagcactttctttcagaatcaaaatgtagagaggcagtcagtcttggagcatgcttttgcattttaggatactactcattaattcagttttaaagcattcactgggttgagcacaattttaaaaaggttctgactcacccagatcctgtttgaagctcaactcattttgattgaaagagatttgagacaagaatttcagaagagaaaaatgtgtgttacacctggacatatatacacatgtaacagggattgtattccttctagtctaagacaagagattctatggtaaattatttaaaaaaattagttttttttctagcattgtattgtcaccagaaagaagagtgctgaattctctgtttctgcatttcccaataataaatctcctaggagagataactttttgcagttgtgccccccacccattttctctgtggcttgctttatttcccacatatgaatacacacacagcagatacatcatgcacaaactttttttaatgtgtaatctgtaaatctaggcccattaagttttcattgaagttgggaaactgttgaggacttacttttgttcttcaccatgcgtgcactttgccaaggatctttggtaaccaataaaacgatcatgttcactctgaa

SEQ ID NO: 900 - DNA, 2344 bp, Homo sapiens
acttttaggctcagaagtacatattcaggtttgttgtacagttctgccccatgccactccccaccaccatgagaaaaccaagaggacaggcctcactaggaaaaaaaaaattagccagtaccttgaccttggacttcccagccaccagaactgtaagaaatctcccagacttcatcctgcttcagctcctgtcatcctgtgctgtggaattcctaaacctcttagcttgagccctgcaacgatctgattttcactccgttctaggaaggttccattcttcagtgtggagcacatataagtaagtgtctatttttgactaaaagagattgcctctcatagcgaaaccttgatattggagaaatgaatgctaaacaaacgagcctaggacttcctgctccttgttcttgggccttcaggtttgaactggacttataccactgactccctgcttagactagaactatatcaccatctttcctgagcccccagctttcagacagcagatcattggccttcctagcttccacgatcaagttgaccatctgggtgactgttctccctttttcactaaatgctatggtctgaatgtctatgctgtcccaaaatttatatgttgaaaacaaataatcaatgtgatggttttaggaggtggggcctttgagaggccattatatcatgaaggcagaacactcaggaatggggtcagtgccgttataaaagatgccctggagagaccttttgtcccttctaccagattggaaaagcattggaaaatttgtccaaagtcactcaacagattcatgatggatcctggattcacagccagctttacttggcaataaaattcaagtcctgttcacatcacaacacatttttaccgaaagaaaaatatgatgtgtagatgtttggaggcatcctatcttaatgaggcttttgttagaaagagttttcttaaaattacagggttggggaaataaaaaatgtttgttgctcagattaacaaaaaaatggtatatagaaaataaagctaagaaaggaaagtgcagacaaccaagagactagaattttcaataaatggcaaaattgtggtgttctgtggttacctcttgaagatttggcctgaatcatgcaacaattgccccttaccctcagtcctcaaattacaatagtgaaagaggtttctataggtattatatttgaatctgctatattttgtttattacttgcaaggacatataggagagcaaaagttttccctctaatttcttaggtttagtaactggaacttgtgaattaaactggcaaaatacagattaacaggagaagagtcatagacattttattttaaatttcatatgcaatgtagttccagagaaaagaagtgaaagcctgaagaagcaattagacttgaggagttatatctttaacaaagggtggtgagtgtagagaagtgactagattttttttaagatggttttaggcttccaagggtgataaaccatgggaaggaaaatacatgagggaaactaatggtatataggagttatttagtaaggtttgtttacacagactaatctcagtggtaagaacggtttttctcctttttctggtcaggggaaggagaagggacaccatcacaatgggaatttgtgctttgctggtagacaaataggagcagagcagagaacttctttctctcaattgtcttcagctcagaataatccttatgccaaacaggcataatttggaattacatattttcatcctctccacacacaagcttccgtataaagttcaaagacagtagtattttcttataattcactctgccccaaatattaactaagatgacattctttttccagcttgattctgcaacattcacttccagaaactttatcactcttaatcctggattgaaggaaaatatttgaatgtgataaaggatatatattttaaaaagaaaggaactataataaaaggcaagattcagaaattatgttgtaatctgtgacttagtgcaatttagtccttgaatttcttgtgtgcaatttattgttcatttcccttggtgaactaactttggttcatcgctttatcattcttctccaggctgtttttgaagggtctgtgagctgagaatggtttttaatagataaatgctcacaatcaatttggggataagaaatattattttgaatctcagttacaaaaaatgttatccttcataaaataattcatttttttctcagtaataaaaatgtatttcaaaaatatggtgtccttattatattttaaattttgccaataaaaataataaaaattgattttctctaattatgta

SEQ ID NO: 901 - DNA, 2991 bp, Homo sapiens
ccgcgacccgcacggcccggacacgcccgccctcaggaaacgccggacgcttgtgggggcaaccacggaccgcaggacagagacccgcgggcggcgggttctctcggtggcgccgtatccagagcagcgcccgcgtgcccaggcggtgatgtcgccgcggccgaggatcctctgtgccagctccggccgcgcagcccggggaggtgcaaagagaaatccttggaactccttgagctctgagaattgggagcaacctcagggaaccaggtgctccagctgctgatagacacaggttgattccaaattggttattgtgaacagtgctgcaatgaacataggagtgcagctaagccttcaacgtattgatttcctttattttggaatccaccctgaaacagcaaactgtaactagatggaaggataaaaataaacatggcaaagcatccacccatcttgaaaacttctgctcagaggtggcatccatcactatgcctgacgtcagtggaacggaaaagtgggaccctcatgtcttggaaatgcagcacttattgactaactctcctgctggaaaagaaacaaaaaatgagcaagctgaacaaatattataagaaaatattttgaaccgacactgaaccaggcaagcggtgatgatatgagaggtcatgacccagagacgaaggaaggagcagagatatgcctgcaaactcaaaagctgcttttcccaaggaaggattttgtttacccaaaagccgtgcaaggaagactagaaaggctgagtagagtgcttgctaatctcctgggtctgtgatgacaaaagatgaaattcagagcccattaaagaagaaacctgtgaaatatgccagaattaaagttaggattcttgaaggactgcacattagcagtatgtgtaaatcaaaaaatagaacagctcccacaaagaattcagcccagaataaaagtatattttatgtgtggaacaaaattaaatatattaaagtgaaatttgacagaatacaaaagagatattctgaaaaccctaatagctattgaaacatttcacacatgtatctcatgcgttaatagaagcagccaaaaatatcattatggggactggaaatgtaaacaatatgattcaaaaaattgaccaaattgacatatattgaatgctagttgcagtgaatacagaatagaaggtctttcagatgtgttagaatagtcaccaaacttaatcagacgtaggagcatgaagttattctccataaatgtcagcgaatcaaatgtacacatgttgtggtacctgctaacatattaaaatgtgtggatgctgttttagtcatggtaagaaggaaatacactcaaatacataaggcagatgggaagaaagactagaaataaatgaacaaaacaacatcttgagaagagagcaaaaaaagcctggtttcatccaatgcatacattattgaaatagaaagaagtattcaatagagaatcaataaagccaaattgtagtactttcacaagattaataaacctaataaaactataataaaactgagaagtacatggagagaaggtagaaattataagcatcaaggatgaaaaaatggccattagtagtagttctagagatagtataaagattaaaataagatgatcagacaagttgatactaataacttggaatatttgattaagttgaaaaattccttgaaaaatacaatccctagtttgactcaagaagacaaaaattatgatatctcttaaataaattttatcctaatgtgatcatcttcctacagtgaaaattcaaactcaaaaaattcacaaatgaattttccaaacgctgaaagaaaaaatatgtaacttaaaaattctttgagatatttttaaaaaagaagaaacaatgtccaactattttatgagaccagaataacatttacaacaaaacatataaagacatgactcaaaagttaaattgaaaggtaatatttactataaatatatattcaaaagtcatgaaaaaaacactaccaaacttgtttcagtaatataagtcagcttgtgaaaattagagttattcattattctgtcagactgaaagaaagccacatgatcctttcaattgctttaccatggcatttgataaagtccaagtatataagcattcaaaaaatgtttaacaaactatgaatgacaggaacttacatcatcagataatgcctgtagtaaaaaaaaatagctgcagacaaacctcatgttcattcatgaaactttccccctaagaaattaagaataagaaaacattgctttctgttaaaatttaaaggtgttagctagttaaataaggaaaataatgtaagatccagaaagtaagtaattaaaatatcatttttccagaatgtataattgtataagttcaaaattcagaatcatctacagataaattagaattaatgacttgctgccttatgaaataaaagaaccatatataacaagtgagtatatctttacaacaaccttagaatttcccacactcaacaattcaattacagaatattataaattccacttatatcaaatcctgtattaccttatgacgtcaagtattaactttgccactctatttgacattgcaagccaccaatccatgtctagcaattttaaccttctgactttattctatttttattttcatagcacacctctctttgtaactaaatacattatttatttatttattgtatatataatttattatctgtttttccctaagttccctgtggatgtgacttatgcttgttttattcattgttgtatctcatatgtgtagatctgtgtttggtacataatagggactcatttctgtaagggttgtttgacctcatgggataccaccaattcactccattatcattgccactctttaggttctgaaaaggtgaattgaattacgtgaattgaattgcgtgttattaaaaacgtttttacaga

SEQ ID NO: 902 - DNA, 5086 bp, Homo sapiens
catacctgtagtcccagctactcgagaggctgaggcagaatcgcttgaacccgagaggtgaggttgcagtgagccaaggtcatgccactgcactccagtctgagcaagagagcaagattccatgataaatttcaaaatgcagaatttattttagcaacaattttctaactccaatgaataataaattaacaacgaaagaggagcaaaaattattccatttgcttgaaaattgttaaacatctttctataataaatcatgagtaaagtcaaaagtaaaaactgaatgtataaacaaattggagctgaaagacaaggagaacaagatttataggatgtggtcaaagcaatgaaacggaagagttccctgattccccttgcagggcgtgcgacaggggtgtggctcacctgttcagtagccccctctgcagaaaccccttgcgagagggggagcacgcagatgggcaagtgcagaggccggggtgagggctttgggctctggctctgcggtagcgtctagaggtgggtgcctgcaaccccagtgttacaaagctctttcagcttggccaccacagacagctggagtgttaaccagctcaatggaccttctgctttttcacaagggcaaaggaccaggggacagctttctgtattccgagctcttttccagaatccaggaaaaatcgggtcacacacggacttgaaggatgaatgcgaggttttattgagtggtggaaatggctttcagcaggatggatggggagctggaagggtggggatggatgaagtgggaaggtgatcttcccctggagttgggccgcccaggggctggactccgctctgactgccccgagccaaacatctctcggtgtccagacgtccctcctcttctctctttctctgctacgtcgttttgccgtcagtcggcttgcctcgtatctcctcacctgctggtatgctctggaggttggggtttggggtttatatgggggcaggatagggggcgtggtgggtcaaaaagcaactttttgggccccaaacagaaacgcctcttctcatttagggccgcgggtatccaggcttgagggtggggccttagccagggaaccgccctcttctactcagtatttccgtctcctgttcgtgtcagcaatacacagaagaaaatcccagactgcaaagtgctgtacttcttgaagcacttgtgaaaactgactttaaacttaacaaaaaataactgtgagaaagagtggatagggagaaatttagatgaatagttgattgagactatatttatttttaataataacaccaataataactaaaatatagcataactttatggaaggcactgttttatatgtagaacatttgttaactcatttaatcatcacttcaaaccaagagatagatacttttattattccccttttaaagttgaagaagccaaggcacagatgagtctaataactttcccaacactacccaattagcatgtcagacataggaacctaacgcatgcaatcattgtccaaaatccatgctcttaataactatgctacacatctgctgttaagtgtacctgcttctctgcctggcacatgtcggcagatgaatataaagtggatgattatgaactgttagttacaatctagatttgtgccataatgggaaaaatactaatctcaaatggaacatgtttatctttgtttagttaaatatagtttgcttcataaaccaaatcttttggatcacggaatcacagttggtggtaagattgggaatcaccactatagcctccctacaaaaatagctcttacctccataccctctaccccattccaactgcaaatgccctagtttattccttcctttcctcttacttgggctgttataaaaggcttctaactaggcttccattattttctctctcttgattatattcattgctactcaagtaattaatcctgctaaaacattttaatacatctctattgacatcctaagtataaacttccttaccatggcattaagccctctgaaatacaactgcaacctgtatcctaagtcttaactttcattactgcttcacaaaatgcctgtgtcaatccagatgtactaactcttactattaatcatggcaattagatataaggttctgaattgttgactccatgggtccaaattttgactctgccaataattagatctatgacttcaagtccattctttaccctctctgaaacttaatcccttagttcgaaaagatctttattcattcaaatcatggcaagaaactccttcaggaacacaggagatagtggtaccaaaaacagataaccacgcaaactatgcaaacttggaaaagtgcattgctttgtcaaagttcattaagtaggtcttaatattttagcaaaagaaaatcttccatctgaacacagggcatgacaaagctcatttcacacaatggaaggaaggctttttttcttgtttcatgtttgtatgtttctgacactgcagtattaacattttaaattgaatctttaaatgatttttctgatgtcaacaacattattgggaaggccaagctcggtagatgaccttaactgaggtggttacagcattgttcccggtaattcggctttgtgatatatccttcttctcctaggtattaaggtctggtttgaattaaagtccgcagcatactcacagctgtggggagtaactgaaaggacttgttttcatctgatggccaaaagactttcttgtaacatactttttaattgaactcttagcttctacctatttccatttctttttttccaggtactaagttatctctcccttattttatacaacttcctatcttcctacctactcccaaattaataaatcccaattaatcaatcaactcccaattaatcaattatctcccaattaatcaatctctgctaagagttccttacccttccactgagcatggctactttgatccttttaccccaaacataagtatttataatatttttatacctttgtatagtatccattttataattttaccatattctttaatagcgactcaactgcacttctctgatattaagaccatggataatataactcaagagtacgtttttttcataccaacaattccatggttggcagtgtccaagtggttaaaaacatgtctctaaaattaataaaacctgggtttgagtcctagttctgtcatttaataattgtgtgagtttgggaaatttaagtcataaaactctagattttaatctcagacattttctttttggaaacaattaaagtctctttgtgctgcatcagaattcacaaaaaagctatccagtgtccatttacattaattatactggtgattgactatggctatgccagagaatgtattccaggctcaagttctactttttgatgactgttctcaggatcatcagacacctgtccgatgtagcagctggaatatttaagcatcacagtgcttttaaaatagcagacaattgctgtggctgaagccttcagatgactgcagccacagctgacagcttaactgcaattttatgaaagactctgagccagaaccacccagctaactccctcctggattcctgaccatgagaaactgtgtgtgataaatgtcgattgtcatataagctgctaaatttgggggcaatttgttatgcagccttagataactattacattagagaataggagaactgacaaaatgtagagattccatttatcactttaaaaaatctttattttcccacttatagaacattaaatacattttctgcaaaacaaacaaactaaaaacttggaaaatataaaagcacctttaatcacaccactcaaaggaatactgttaacctccaatggatgtctccattgcttcttcagtagaatccccccaaaaatgtttttatgggttgaaagcattaaaaagagtctctatttgggtagactcatttctaggtagtgagattgtatcttactcttcatggtatcaaccccaagagctgacacatactatgtgctaataaaaatgtttaggggatagttcatcagtcttattagaaatcagacaaaatcaaaatatattaccaaatgaactcaattccccatagtacctgctgtgaagcaggacatttagaatgtaaaatggggaaataattttactctcctgcatttgtacagagaacatttgagtaacagttttcccaagcaaagtaaaccaaatatttatctggtggatttaggcagcagaacacaacacagagagtttacatgtttcaagaagttacatacctcctgcaagcgatataacctaatatccaaattatcttagtcaatttgagcttctataacaaagtactataaactgggtgacataaacaatagaaatttatttctcacagttctggagactgaagtctgagttcacggtgctagaacggtgagggactggtgagggtcctcttctggttgcagactgccagcttcccattgcaccctcatatggtggaaagacagctagctagctctctggtctcttcttttaagagcactaatcccattcatgagggctccactgtccaaaggcccttccatcaactactatcacattgggattatagtttcaacatacgaaatttgggaagcacacaagcattcactccattgcacaaatcttctgacccatcctaaacttattaggttaccttatctcactaaatgcagaaactactgggagtgaggctgccataaatctcttctggagaattttactggccataaagaagacagagaagaccgcttgcaccttcccccattaagtaacctctcccctattaggtatataaacccccatctttagttgtttagagtcacatttttctgtgtgctcctgcgtgaataaaaatctatgttttgtctaagtttaattcccaggccctcaagaactgaacctaagagggtagaggaaaagattttcctctccaacaaacattacttacaaaggtaagtaatttcatcttcattaaaaacatgagaaaactta

SEQ ID NO: 903 - DNA, 341 bp, Homo sapiens
atagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatt

SEQ ID NO: 904 - DNA, 961 bp, Homo sapiens
tctaagtcagagtcttctaaaaagcctgaacagctgaggaagctcttcattggagtgttgacctttgaaacaactgatgagagcctgaggagccattttgagcaatggggaacgctcacgaactgcatgggtaatgagagatccaaacaccaagcgctccaggggctttgggtttgtgacatatgccactgtggaggaggtggatgcagccatgaatgcaaggccatgcaaggtggatggaagaactgtggaaccaaagagagacatctcaagagaagattctcgaagaccaggtgctcacttaactgtgaaaaagatatttgttggtggcgttaaagaagacactgaagaacatcacctaaaagattattttgaacagtaagggaaaattgaagtgattgaaatcatgactgactgaggcagtggcaaaaaaaagggctttgcctttgtaacctttgacaaccatgactccgtggataagactgtcattcagaaatactgtactgtgagtggccacaactgtgaagctaggaaagctctgtgaaagcaagagatggctcgtgcttcaaccagccaaagaggtcgaagtggttctggaaactttggtggtggtcgtggaggtggttttgatgggaatgacaactttggtggtggaggaaacttcagtggtcgtggtggctttggtggcagccatggtggtggtggatatggtggcaggggggatggctataatggatgtggtaatgatggaagcagttttggaggtggtggaagctacaatgattttgtcaattacaacaatcagtcttcacattttgggcccatgaagggaggaaactttggaggcagaagctctggtccctatggtggcggaggccaatactttaccaaaccatgaaaccaaggtggctatggcagttccagtagcagcagtagctatagcagtggcagaagattttaa

SEQ ID NO: 905 - DNA, 2451 bp, Homo sapiens
agagaatgatagaaggcctctcctctgccccacctctttcatgcctttcatgtaggcaaagtagacagggagggtgttttctcccaatcaagctataatcaaactgacttagaagaagctattaatgcacagatccatcattgcttggctatggacaaacgggcaggtggtgctgcacaacaggctgggatgagctctttttttccttcctggacggaaaaggagatggacctaaacagctctgagcagccaacggagggaagaagagattcctagaaggcaagaaacaaaatggccaggtaacccatctgaatagtatccgggcattagcacaggctaccagccaatcagaagcaaggaagtgaagaggaaaggaggactgagggattgttttggctgctggtcactcagagactaagagagagagccttcagactccctcattcccttgtgggatttatgaggaaactaagacccataaatatcaaaaatgtgacccaaggccttggatatagtgattgtcagagttgccctcaacctgggacctctgggatcaagagaagtgagccttggactaactacatgttcactctcgcatcggaaattgggtgtaatttggcttaaatatggggcttggggattgttatcaatttgttatggcacaaattgtcctttttcaatttgccttttctcttcccttcttccctccaaaatatccccctattctttctccctctgcacttccaattcagaggaactcaggtttttacttccttaggaggacgtgctagcatcaccggtgttgtgggccttgagccgagggcctcaggactgtgatgaggctcagggccacagtaagagcagggtttcctgaacacaacactgcacttaaccacacctgggtgaaaatttcattttcttcacacaaagactgggctctaaagtgtccagtgttctatgagtctcgataaggtgaaataattctgttattgttgactcatagattttctgcttgcatgtatacctaaagactttttgcaattcttgccagggtatatattttttaagatacaaaactgtcttacaccccacagcaagctttaatcctgtgaggacaatctgtttctcctggcaacactaaggctactagatgaacaggggtcagccgggtagtttgaagagaagccttggtaatctgttagacaaagctgagaattctctaaagaatgtctagcaaagatacttcagtttgaagtgaatagaaagggttttgttcacaggccctgccttgctgctggattcaaagaatgtgcagcaccagaaaaggacatcaatgtccttcttgaaaatgaaacacacacgcgcacacacacacacacacacacacgtgtcttcttttctgcctgcattgagcattgcataactgtggaaaagttcatcacgcctgaaaatatgtatctttcctttgatccaaagcaagtgctatattggaataaagatgccatatcttccgcctttagtaaaatgaattgtcaaggattttgcttcagaaagatcaagaaaagaccaaacgattctgcagggtgaggcctcagagttcaggctgttgattaggagttaggggccctgtaagtcttattggttctcagctttctcactagctcatgtttgtgaccttaggcaaggcacttaagctctttgtaccttcattcctccatttgaaaattagagataatacttgccgcctacttaaactcaaagggatatgtgaggattagccaattaaagtttgccaaatgcttgggaatcaatggagggaaaaatctgtatgaatataaggtatcattgtcagtcccgcctgactccctcttcactctcttacccctcctgtttccaccctctcttttaaaggattgccttcctgggaaactcatgagcattatgcatggttttacttatggttgctattgtggaaagtggccatctcctattattaagtgatttgtttgaagttggtcctttctataccatcacgggggaggtttccaaatcaaagcatcctagactgattgtcagtgaggcacagctggcaaggtttcttttgggtttacctttagcatcctgtagagaggagaaaacaaccattttaatgtaaaatagtaagcataatttggaaatatttgcccattaggaatacaaagctagtgaggtacaaaaataaagtcaatttagagcccttgttacaatccttgaagaaattccccttttaaccaaaacaataatagtgcttcctatttcataaacgttgctcctctggctgttacagccacgtgaaaaatgagtgtaacataactatggcatattatctgtttgtttcacaattggaaaattgagatgcagagagattaagtgacttgctcaccacaacttagctaacgaacggaacggcaa

SEQ ID NO: 906 - DNA, 5965 bp, Homo sapiens
ctctttcatgcctttcatgtaggcaaagtagacagggagggtgttttctcccaatcaagctataatcaaactgacttagaagaagctattaatgcacagatccatcattgcttggctatggacaaacgggcaggtggtgctgcacaacaggctgggatgagctctttttttccttcctggacggaaaagctgccacgtctttgagctgctgagatgttgccatgatgtggtggtgcctgaggagtggtcctttctttggcatctgcaggccctgaggcatggtctggaactggaagaggaacaaagggttgctgaagtctgctttgcaggtgtagctggcttgctgaattcttctcctttgcctaaagagagaggctggaccattcctaataaggtaagctcaggcctggaaaatatcggctcatcacctagcttcttcaagccaaaatgcttttgacctacctgcacactgctcttttgctaacaactctcttcctatctctctgggtttccctataaagaagatagaagggtctgtttctccttaaggtttgtaggaactctatcccaaaaataaatccctccttaactgcatagcggaacggttcactgacagctccctgtctcactgtgggctgaccttctcctggctgactctgccaagaccctcatattttaaggatgatgtcttacttcccagtttccaccccacagcccacctgcctcttccattcctccctctactcaagcaggagatcgatgatctaaatccctatttgcagatggtgagaatgaaagtaatataagatataaagtaataaggcataaagatgggactacttttagtatgaatcatttgaaattcctttctcattggtcaaaaagcagttaaatattggcaatttcagatgattcacctaacgattctttttgcccaaggaggcaatgtgaggtgcacatcagttgcctaagtcagctagactcattggatgcccttgacttcaactactgcacatgcctggataattctcaaatatgcatctccaattcagcttctcttctgacctatcagacatcctcatttggatgtgacaaatgtaccccaaatctgtgatgtccaaaatggcatcattgttccccacttcagacctgctcattctatatccctgtggcaagtgcctccattatccaaagtcaccaaattctacccaagggaatattcgtagctgttctctcttaaatcctccgtctcagttgatagacacataagttaataatatctccttcatcgtgtttaatctcctttctacctccccactgctctcttctaaattctcataatttcttactggcattctagtaacaacctcctaattattttctctgcctccagttttctcacatctccaaagcctgtggaatccttcaatcagggacatttttctgaaacacaaatttgatgatgctcttcttcttccatgtctcctattgccttttggtaaaggcctcattcctaaacacccacaagaatcttttatctcatggttatcaaaggaggttgggatctggcagtattatctctctctgtctcttttttattttcagacagggtctcactctgttgcccaggctggagtgcagtggcacaatcacagctcactgcagcctccacctcctgggcccaagctattctccttcctcagcctcccaagtagttggaacagctacctgtgtgaccttgggcaagtcacttggcatctctgtacccccatttatacaaaggcttttgatcatcagtcttcacatggtctcccacactgccctgtgctgatggagcagagacgcaaatgacgtgggccatccactttaactgtctttcaaggcctttccaccaggacagtacctcacaggccttatggcctttggagtctggacagcctgaattctcatcagtaaatacttcaggtacctaattactacccagggaggaacaatgtggaactacaagcccagagatggctacaggtgggcagaagcgggagacatgcaccatcatccttccagaagaggaaagtgatacgtaactgtcagaaatctgattaaaatttgcacatgaaatcagttagataaattatagaacataagtcatgattctacttctgaaaaagaaataatgggtaatttttcatcaaaatagaaaataaatatgaatcactacaatacccaagtagttgttcccatcccttccacccccagcaaatgtatgcacaccttgtgccagtggatgggatgcagtattggaagtagaggaggctggagggggtggagggtaggaagaaagaacccagatgggaagaggtgggaaaatgtcagagagaaatttcccttgagtcccaatttgcctggagctgcttctgcctggagctctacaagaaaagctgttcagaaaggaggccaaagagagaggggagaaaataaactcctttgtgaggttttccagaggtacacatttctgaaaagctgattgtatttcttcctaatcattccagtccagagtccaatcagcacaaagactgagacaataaactcacatcacaaaagtttctgggatccaggcttcttttcagggacaaataatacaatttccatctggataatttgttcatcatggccctatgttttcttaactgtcgagtggagaaacaaaggcaggactcagtaccaacttctatcctctgtggatagcacaaagacatcctgcatttgccctggaggagcagttcatcatttgactgtattttgtacacaaacaaccatttttcaatcagatcaagattttcctactttcattcatcctaataccctacttctgcacaatcagtcagattggctgagcagaaaggctagcttgttcatccgtgtctggaaatgccagatgtacttttttttttaagcctggaatgtttttcactgaacttggccaagtgtctgctcagaggggagctccaggtgctacccctggactaccggctcccgggctgcaaggggtctgggtctcgagttggattgtgagggctagagcattcccactcaccccagtaccctgcagtgagccggcttggagtggtggcaagagcatacatttcagagacagtttctagcaaccttccttactagctctgtgacttcatgtctcatagttggcacgcagtacatggtagctattgttaacatttattagtgacaaatgccaccagcattaagacactattatcctctagtcccttgctactcataatgtacccacagatcagctgcttctgcatcacagggagcttgttagaaatgcgtcagaatctgcattttagcaagatctccgggaagttcctacacattaacgtttgggaagtgctgcagtctagtcaacactccctggcttcctggaagggccaacccacccagtcacaatgcttttttcaggacaatctctcctgtgttcaacatttttttctacaacccaaatcttggcacatagccaaatcaaatatgaattcatctaatggaaacaatgaggtagaatatttgacattgagtttcactatcactatgtttaactcctgtctcataaccattttgctttcctatatctgaaaaaggggaagaattattttaaacagttcaccactccagccccttttattctagtcatgggtgaggctatatgttagctttttatgcatttctctgcctaaacatttcttctaaggaaaaaagattccccagcagacacaccatgggaatctgccttcttctggaaatcagtccctgcactgatggagctggtccaggtaacgcctggcgtcccctcttcagtgaatgccacaggccctgcctttttgatgcccctttatttcagctgcgtgggcaggacaccaggctatttgcaacagcaatttctgaacatgacttgcaatgcatacttgccagagagctaccacttcatcaggactgactgaattagaggcagagacagctgctgctggtaaagtcttggtttcttggtcccaggcctctggttcccacatgcgatgccatggagaccctgtttggaagcagcaatgccccctgaactgtgagctatcactctaaatgtttgtgcaaagggagttcagtccacattcattttttgtaattattttctatttttccgattttccattctagaagatatatatgttcacggtatgaaactttcagccagagtgggcctcatcaagtagccttgaccaagaactatgtagttcatgggctgcatggaattgctctggcaaccactagaatcaaaggaggggctgactgtgggttctggagatagtatgatatggtagcagggatttggtcatttccaagtaatacaaaaccaactcaaaccagctcagattggcttggtaactaggaagaatgctgggtggctcacaggtagaagaaagagttatagaaccagaaacttatgaattgtaatggggatcttaatgtttccaggagtttctctccttgctgtgtgtgtgtatatatggatctatatcacacctacacacttacatgtttgcatgtatttggttataatgaaacctcattaaatggtggtgtgctggcttcctttattctaccagaaaagagggctatgagtctttctttgtctcattttttctctaatatgaccctaaggggtcagcaacctactggcctagtagcctgtttctgtatacccccccactcccacacctggcaagttaaaatgatattaaatttttataaggttgtgaaaaagcaaacaaataatgaaggctatgagacaggaccatatggcctgcaaagcctgaaatatttactatctggccctttatagaaaaaagttgctgactcctagaaggtaagagacagtcccttacctcctccatcaattctaacagaaacttccctgggagagaggagtcctccctgaagagtcaatgtggcaagggagaccagggatgctgattgaccaggctcaagtcctgtgacctcagggtacctgggggcagaacaggagctctcccaagaaaaagcagtgtacagtttcccaaagaaaagggaagagtcactgggaaagcccagtgggataccctgtaagaaaacagatgtcactcttaaaagaggactatttgcaacagcatggacagcgtggaaggatggagaagagcattgggactaggaacagaggactcttaggcctgaaggggtaagggaggggagtcattacctaaatctacaggagccttgactgtcagcttggtccctgagctggagagagagagaacacagcaaccactaaacagcagcccaggggtaagaaagctcccactttccccaccctccaggcaagccaacaagaagccagaggccaagtccgagaggccaacttcctgggcacagagcaagtttcctcatctgtaccacgaacttagatacgcaaagggcctgctccacaggcatgagcaacaacacagacagtttcctgcctttcccccaagtactctctctccctctttcccaggagatggacctaaacagctctgagcagccaacggagggaagaagagattcctagaaggcaagaaacaaaatggccagattctgggcactcttggctgagttcctctctagcaactggcaacagccagatagttgcctccaccaagatcatcctcccctctctggcagaagaatgtttggctaaaggagaagtccaacacctcttcctcagggcagaacagctctgacagaccatctcttttccagaagtcctcataagcttggctgaggcctttgttgtaattgcattacagttccatttcttactaggcccaatacttttcccttacctcttatggctattattctcaaaagtatgctctcaataaac

SEQ ID NO: 907 - DNA, 2821 bp, Homo sapiens
ggaccatgacccttaacctcaagattctgtgacttgtcagggtggaaaaaaatgtatgtaaataagtatagatgtgataagctttaataaagagcaggggaatttagagaaactgtaccaagcattaaatgtattatttttagtaaccagaaattccttctattgatgtaattaagattttatagtgtttgagaggccaaggcaggaggaccacttgaagccaggagttcaagaccagcctgggaaacatagcaagaccctgtctctccaaaaagaaactaaaaaattagccagttgtggtggtgcacacctgtagtcccaagctgctagagaggctgaagcgggagaatcacttgagcctaggagttcaaggctgcagtgagctatgcttgcaccactgcactccagcctgggtgacagagtgagacactgtttcaaatagaaaaaaaactgcatatagtactttactctcagatatgagtgtttctgttgaccaggaattttaccattcctggttctctgatgcggaggtggccttgtgaaaggacacagtttctgctgagctgaacacgctttagtgtaatctgatgaagaacttctatgctggttgcggtattggtggaaagtgttttattttgcagaaaaagcacaaattccacagagggcaacagttatccattcactccatagctatctattgctgcatgacagactaccccctaaaacttagtggcccatgccactattttattttgcatgattctgtgagccaggaatttgggcaagattcagcagaacagctctactccctgtggcactggctggggtcatggacggttgtgtgccactggtgggtcagttgagaggggggcccagccggcacagggacagtgaggctggaccatccaaggggcttctttcaggtttctggtgcctcagcttggatggctgaaacagctggcagctggccagggctctccagcagggtggccagacctctatgaggtggcaagggctctgaaagtgaatgctccacaaggatgggcccagtgtgtcccccttgcatcatgctggctcatggatcactggccaaggccagtttcgtggccacacccagagtccatgtggaggggcctgcacaggacatgaagccaggaggtatagttcacaggggaacacaaaagtaacgttcactgcagggacagagcagatcactgaagggaatgccactgggaatcgagccccatgtcctggcccctgagcagagttctgtccccaagaccattactcctcatggaacttttcacctccctcacacttacggcaatgctaacagtcactacacacggttctgagaaccttcaaattgaagccctcatgatgtttcctaagaagttgcagttgtccaaatccacaaacccagattttagttggcaagtctgagaggttctgggtaactgttttgctgcacaaacgtgggtattcctgaaagtttaaagattcatcttcaacatgctagggaaagccaccatgatagctagtctaataatgcccagaccatcccctcattgatgaatggaaggctcacattttaagatgaatatgggccagggaggtttcacctttcttggctgaggttgatgccaaagtgataaaccttggtgcttcccgcctccctgttccctggggatgggccagaatcagatgccatcagggaccctgcaggcaattctgagaattccttttaagaagacacctgcaggaagggtgaaccgctttctagcccttctgcagccagccactccccctgccttttgatgacacaggttctgcataaggtgagagggaggacagggtgacatccatttcttgtaaaaatgcctcaatgagaaaagggccacatgcatttcttgtaaaaatgcatcagtgagaaaaacaacagcagcagcaacaacagcaaatatttactgaatctcctagtatgatccaagcccccaaatcaagaaaatgtgaatgctgatgtaaaaaaggaaggtatttgttcaaactgcctggccagtgtttttgaagaaaacagagatctccagagaccccttttttggtcctaagtagcaagcaaacaagttcattaaatgtgtactgtttatttgtgatgtctccaagcagagtagttggctcttgttatatatctgggagaataatcaatgatttatgcttctgacagtcttatcatagccatttacataatggtcatgtgtatttgtgactttaataccctctgcatatagccttaatttttaaatggattacactgttttgctgttgtgactttgcttgtttaatcatagctaagacttttctgaagtcaaatactttttccattatcacagtgaggcgttggcaaaaaagtgggggcttgctggttacacttgctgaaaataaatcttgcgtttatttggactctcaagattggagctctgaattcacatagtccagtgtttatgcacagagcaccactggcattgccattgattacgactggcatgaccactgccagaggtttagcagccctggcacacatccaccaaatgccatttcaatcactcagaaatttctacaacaacagaaggccccccacatgttgggatagtgggctgcccttgcttgagcacagctgatcgatccaaccactggtcagcggttgcatctcctcttcaacactcccctaaagggacagatcagccgggctctgctccagcatccccagcgatgaagaagtcaccacctcctgaagccacattggcctgtcctcattattaac

SEQ ID NO: 908 - DNA, 1757 bp, Homo sapiens
actcgtggcctgacgcatccgcgagactgcacgcggccaggcgggggcacgaacgggttggggcatgcgcgggcagcgtcgagtgggtcccttgggggtgggggtggggggcagtcgaactagggagagagtctgtggaagggctcagttgtcacttcacacctttccccgctgtttattgatctttaactctctctgtgtgtcctctctctctctctctctccctctcctctctctgtttctctctctctatcccttcctgtccaccctttggggccatctcttccaagaaacaaccgtctctcccagcccatgggaaattgtctctcctgcgaacttatccaacctgagggggtctcatccatgccgataccggctgcttgtggaaccttgtaagagttcttccctctccctgtaaaatggagataagctgtgtggtgctgaggccagcgccgggcacactcaccctcaccttcttcctgagagaggaaagagcctggagacctggattctacctctgcccccaacccctaccacagggtagccctgccaccacctgctggttctttgggcaagtcactcttttattggacttccatttcctcagctctaaaatgaaggaggtgagcccagtgtggtggcacctgtagttccagctacctgcaggctgaggcaggaggatcgtttgagcccggggggcagaggttagagtgagcggagatcttgccactgcaccccagcctgggcaacagagcaagaccctgtctttaaaaaaaaaagtgattaaaaaataaaaataaaatgaaggagttaaacaaactcaggaattttgtatgaatggcataaatgagcacattagaaggaagcaactttccttctctctttttttcaatcctgtacaggccagcttcccctctgccctctgctcccctcctccctccctaccatcctccagccccccaaagccctcccaatttgagcctccttttggaaaacatctctgagtatggtaccgttggtatcggtgactaagaggctccaaggatacccttctgggggatttccaaaataatgaggaagtccatttccaaaatcatgggaagtcccaactgggcctcccagacagttggccactgagtctgtcccctaaaggatctgcttgacttgcacagtcttaaaggcatcatgtctggtttttaaacataatttcagttagtagccaacagttcagatcaagggatcacacggcctgtttgacctgttcttgcagggtcatgcatgctccactgagccatgggaagtgtccacacccagccatgggagccctgtgggatctgaaactgacatttctgctttaggtgccttaagctgaagaaatgcatagtagcgggaattggagtgcaagtgagtgcagtaggggaagtattttgccataagaaaccctaagcctctatggacaagaaattctccaggggcagactggccttgaccccagaaatgtcacattggactcggccttggttttcctcatctatacaatggtcaatcagactagtggtttgttttttgtttgtttgtttgtttgttttctctgtcgcccaggctggagtacagtagtgcaatctcggctcactgcaacctctgcctcctgggttcaagcaattatcctgcctcagcctcccaagtagctgggactacaggtgcacgccaccacatccagctgatttttgtaattttagtagagatgaggtttcacc

SEQ ID NO: 909 - DNA, 4892 bp, Homo sapiens
gaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaagtttcatggatttgaatgtgaacatctgttccctggacgcactgccaacaacgtggtccaactggtactcatcgttggaactaccaagtcaactaattttttttttttttttgagacagagtcccactctgtcgcccaggctggactgcagtggcgcgatcacagctcactgcagccttgacttccccagggtcaggcgattctgtcacctcaggctccctagtaggtgaagactacaggcagacaccaccacatctgagtaattactttttgtagagatggggtttcgccatattgcccaggctggtcttgaactccctaaggtcaagtaatccacctgcttcagcctcccaaagttctgggattacaggcgtgagccactgcatccagccagtcaacttttaataaggtccttgttaggtacagtaagggacatgagatgaaaaagagctggactgtcttcttggagcttacaggttagttagagaagatattaaaagacagatgagatgggcctagactctctgcctacatctttctccagtgctggatgctccctgcccttgaacatcagactccacgttcttcagttttgggactcagactggctctccttgctcctcagctctagacagcctattttgggaccttgtgatcataatttatttgcatgggagctcctgggatcatagcagacaggaggcaggactagattgtagcttcagacagagcagcatgcagaggcttgcattgtgaattttagctctagatcaactgcaagaacaaaccagcaatcctgagaggacccacagaccctctgaaggaagcggattgctcctgcagggcccgggagacccccaaatactgtgagtgccccaactgtggaagtgggaaagggagatcctcctctcccgaacacacacccccccactggagaggctgaaggtctgtttgcaggagaaatttccaactttacctggagctaagtcagactcagcagagcgaactacaggggtagaggaagcagcagaaaggccgtgggagctcgctgggtccccagaaggcccattcctgcctggcaccacagggatccatcgggagggtggccagaggagcaagggataaaactccacagggagaagaattctctagtcgaacttcgtaacaatttaaacagggtgagaagcctcctggccagaacttgggcaactgcacgaatccagcatgcagacttcacaggtgggggaagaactacagcccttttctttcgctgctgggaggggcacagccttggggcaaattttcaagccagtctcaccctctgcctggaaacagactcggggcagttgtgggggaacacggtgggagtaagaccggcccttgggtttgtgtgggagctgggtgaggcctgtgactgccagctttcccccacttccctgacaacctgcatgactcagcagaggcagccataactctcctaggtacacgactccagtgacctgggaatctcacccacattccctacagcagccgcagcaagacccgcccaaggagagtctgagctcagacacgcctagctccacccccacctgatggtccttccctatgcaccctggcaggaagacaaagggcaaataaatcttgggagttctagggccccgcccactgctggttcctccccatattaccacagctgatgctttctggaaaggaccacctcctggcaggaggccaaccagcaaaaaaaatagaccattaacccaccaaagctccattgtaccctctgccacctccaccgaacaggcactggtagccatggctgagagacccatagatggttcacatcacaggactctgcagataacctccagtaccagcctggaactgggaagattcgctgggtggctagacccagaagagagacaacaatcactgcaagtttggctcataggaagccacatccataggaaaaggggcagagtactacatgaagagaacaccccatgggacaaaagaatctgaacagccttcagccctagaccttccctctgacagagcctacccaaatgaacaaaccctggtaatatgacaaaacaagacgcttcaacaccccccaaaaaacatactagttcactggcaatggatccaaaccaagaagaaatacctgatttacctgaaaaagaattcaggaggttagttattaatcagggaaggaccagagaaaggtgaagcccaatgtaaggaaatccaaaaaatgatacaagaagtgaagggagaaatcactcagggaaatagatagcttaaagaaaaaacaataaaaaattcaggaaactttggacacatttttagaaatgcaaaatgctctggaaagtctcagcaatagaattcaacaagtagaataaagaaattcagagctcgaagacaaggtcttcaaattaacccaatccaacaaagacaaaaaagaataagaaaatatgaacaaagcctccaagaagtctgggattgtgttaaacgaccaaacctaagaataattggtgttcctgaggaagaagagaaatctaaaagcttggaaaacatatttgggggaataatcgaggaaaacttccccggccttgctagagacctagacatccaaatacgagaagcacaaagaacacctgagaaatccattgcaaaaagatcttcatctaggcatattgtcatcaggttatccaaatgagaggtgacaatgtgctagtagccctcactcgctctcggcgcctccttggcctcggcatccactctggctgtgcttgaggagcccttcagcccgccgctgcactgtggaagcccctctctggactggccaaggccaaagcgggctccctccgcttgtggggaggtgtggagggagagctcgcgggccagtgagggcttggcgggccccgacctaggagtggccggctggtgccgccggccccaggcagtgaggggcttagcaccccggccagcagctgtggagggtgtgccgggtcccccagcactgccagctcacccgggctgtgcttgaattctcgctgggcctcagctgcctccccgtggagcagggcgtgggacttgcaacccgccatgcctgagtccccccctccccctgccctgctccctcatggccagagcctcccggacgggcgccgccccctgctctgcaaccagtcccattgaccgcccaagggctgaggagtgcgggggcatggtgtgggactagcaggcagctccacccacggccccagcatgggatccagtaggcaaagctagctggactcctgagtcgggtggggacttggagaacttttatgtctagctaaaggtttataaatacaccagtcagcactttgtgtctagctcaaggtttgtaaatacaccaatcagcaccctgtgtctagctcaaggtttgtaaatgcaccaatcagtgctctatgtctagctaatctagtggggacttggagaacttttgtgtctagctaaaggattgtaaatgcaccaatcagcactctgtgtctagctgaaggtttgtaaacacatcaatcagtgctgtgtctagctaaatctagggacttggagaacttttgtgtctagctaaaggattgtaaatgcaccagtcagcactctgtgtctagctcaaggtttataaacgcaccaatcagcaccctgtcaaaacagaccaatcagctgtctgtaaaatgggccaatcagctctctgtaaaatggaccaatcagcaggatgtgggtggggtcagataagggaataaacgcaggctgcctgagccagcagtgcaacccgttcgggtcaccttccacactgtggaagctttgttcttttggtctttgtggtaaatgttactgctgctcactccttgggtctgtgctgcctttaagagctgcaacactcactgcgaaggtctgcaggttcactcctgaagtcagcgagaccacaaacccaccagaaggaagaaactctggatgcatctgaacatctgaaggaacaaactctggacacaccatctttaagagctgtaatactcaccatgagggtccgtggcttcattcttgaagtcagcaagaccaagaacccaccaattccggacaaagttaaaatgaaagaaagaattttaagagtctgtgagacagaagcaccaggtaacctataaaggaaaacctatcagattaacagcagatttctcaggagaaacactacaagctagaagggattggggtcctatgttcagcctcctcaaacaaaacaattatcagccaagaattttgtatccagcaaaactaagtatcacatatgaagaaaagatagttgttttcagacaaacaaatgctgagagaattcaccattaccaagccactgctacaaaaactgctaaaaggagctctaaatcttgaaacaaatcctggaaacacatcaaaacagaacctctttaaagcataaatcacacaggacctataaaacaaaaatacaagttaaaaagcaaaaccaaaaaacccctaaagtacacaggcaacaaagagca

SEQ ID NO: 910 - DNA, 1331 bp, Homo sapiens
gatctaacctatatctaattggaattctagaaagataaaatagaaataatgagagccaatattcaaagacataaagagattatcattttctagaacttatgaatgacatgaattcacagatgaagaaaaaagatataacaggcaagataaatagaaagcaacagttggacatagtatggggaaatgcaggacaccaagacaaaagcagccaaaaagaaagggcagattatctacaaataaattgtaattaggctggtaggtgatttatcaattgtaacagtggaaaccacaaaactattgaataactttagtggaagaaaattttgtcaacttagaaaaactgtcttaagacaatttagacttaaacaatagtttactacaaaaaagtctttattaaagaaacttctacagtatgtacttcaagaaaaataaaaaataagagatttggacctaacacctggttctgtcactgattccttgtgacatggactccatttcttcaccttagaacaaatgctgctggagagattattcctctgcttaatggagggattattcctctgcttaaatttaccatttaaaaataccaccaaaaccacaaactcttaggatgcatgaatacagtttaactgctttgaatagcatttttaatagcaaaaatgtgtttatactataatagcttacaaccatcttttcaaaaattcccagtttcatggaacttccattttagtggggacaacagacaaaaatgcaaaggcccttctgaagcaggagtgtgcttagttgaaaaaacaagtcagtgtggcaggaacagactgagaatgggagataagtaggagaaagggcagtaatgctggtcattttccatttgctgctctaaatctgacctgaatgaaccacatcaacaagcttctgtactccctctggctgggtccgccagcctgtggtaggctaaataatggccccaaaggtatccaagtcctatcccctggaacctgtgaatggtaccttatgtggcaaagtgactttgcagatgtgatgaaattaaggaccttgagacagattattctggattactcagggggccctacatgtaatcacaaatctccttaggcgagggaggcagatttggcagcaagaacagaaagcagtataacaatgaaacaagatgctatgttgctggctctgaagatgaaagaaggagccaaggaatttggttctagaagcaggaaaaggcaaggaaatagatgttcccctagtgcctccagagggaatacaagtctgctgctaccttgattttggtccacaaaacccatttcagacttctggcc

SEQ ID NO: 911 - DNA, 2005 bp, Homo sapiens
aatttgttgttgttgcttctggcttttaattttattgtgatgtggtctatagaatgctacttctttggcatttgttaggacgtggttggtagcatactatatggtcaatttattaatttgtaattttttaattaaaaaaggttttagagacaggatctcgctatgtttcccaggctggagtgcagtcactattcacaggcaaaagcatagcacactacagccctttaactcctgggctcaagcaatcctcctgcttcagctttccaagtagctaggactacaggtgcatgataatttcacttcacactttatttttaaaagtttatttatgcttgagaacatgtgtattctttaattctcagagttctatatatgtctctttgttcaagcttgttaattatgttgcctcaattgtctatttaattactaatttttgtctatataactactgatttctgcttagatctatcaactacggatctatcaaatctgtgaaaggaatcttaaaatctccactatgttgctatctaaatttcttttccttttgtatcagttttctgtagattttgaggctaaactgttagtgtgaacaaaagttctctgaaaaggaatgtgaaagagactttactgcagtgaacagtttacaaattggggagacacagccctcagtgtaaaatgaaggtgcattcctgagaacaaagggaggctttgggtttcacagtgaaagctcctgtccaggttcctaataagatctgtttatgcaaatgaaagatacaaacttgcttagttctgactgggtaacagagctgagctctgattggttgatacagccgagccctgtttgttgatacaactgagcttgcatcaacattggttggttcaggtgagctctggatgtgtatcaaggtggaacagaggtcttggttttggcagaactcagagttggtgtgtgaactgtagtcagccaatggtcgcttggctctattataaatgtaggactggttagccacttgggatccatgttgaaagattggctctttcagatatatgttcacattaggtacatatgtgattattacatctttacgattaattttttctttaatgaatatgtaatgtccttcttattcataatcatgtcttttgtcttaattattctttcatctgatactattttttcaccagtggcttttttttttttttggttaatatttgcctggtatatccttctatcctttatcattcacttttctattttagatatgctccttataaacagcatatagctaaaacttttcctattataagagtttccactttttaattaataagacaatctctttacatttattgtgcttgcttttttaaaatactaattctctttaacttcctgccttgtactggcttgattatgaagtttttgtgtgcttatttatatgaaatattccattcatgaagataagaattgagaccagtataggtaaaatgaacttcacacacgcagaacgcagctttatcgaattgtttttcatcctttgtttggaaatcacagattctgctcctatttgttttagtggtagccattagcttttaaacatgcatctgtgacctaacccaggacaagaaacttcaagtacttttattccaatctcatcatttattcagtttgtaatagctttttagtattttatttaaaaaaatcctttaaactactcattatttctctttttgatagtttgagtcaatgcctgtctagatttacctatagacttgacaactatattgtttgcctgtgagcattaaaaaacaatattttctgttagtggcgaactgtaatagctttttatgaaaatgtctttattttactctcagtttttagttgtggtttagttgataatagaattctaagttgctagttattttccctcagtactttgaagctattattccagtattttctatcctgtaatgttgctattagaaattctgttgctatttgggttat

SEQ ID NO: 912 - DNA, 2618 bp, Homo sapiens
agacgccctgcggccgctttgcctgaccaaagtctgtgggcgtggaacaggccctgggttctcctactgggaagaatgaagttcaggtactccatgtgatatatggttccacaatcctcagcgtgttaactgaagccttgttgagtttaacaaagctgccattgaagatctggggaaagtgaagaagttgcaacagagttttgggctcacaccattgatacatttgatccttaaggcccaccccgcctcactcccaccctcttctacttaattcaggatgtgaatagcacatgccttccatcttcagacaaacactgaggcctggacaatgacctgcattaggtagatagaatctactgaaagctaaaagccttttcctgtgtcttagcagcacggaagccacgcctccttccccccaatgtttgtgcaaaccctagagaagaggagacagcccctatgatgtgtgaggttgaatttcctgccctcaacccatcaaatcaggcagaatgagggctcagtcagaactacaactacaaaagagaaaaattttaatgtgacttttcttgtctgctcagatttttgggttaaggttcatgccagctacattctttgcataataaaatataaatagagtataaattgttctagttagagaaaacagcaaaacagtgctctcccaagggccctaataaatcactttacagaaacgtggatgtgtgttggatttacaggatttctatgccaagcagagaagtacgtgaaaacaggaaagcaaaatgcataagttgcaataatagttttgtggtttagctgaataatgtcctatatcaacagaggataatgattttagtttttcagttgccccaagatcatttccattactgatgaggcttgaaatgtctgtgaagaagagtcattgcaattgatttatttgtctggcaaactttttgtcagcaaattcaccactacctcaaaaatctcactagctactctatgcttaagacattggaagcataagccacaatgaaaactaactcttagcattagaattctaagaagcagtaatgtatttatgattttatgttaaaaatctcccagatgtcagcatttaaatcacaattcagtaatataagtaatttgaaattagaaagttttatacttcaccattctattttcctcttcaaattgaacacagtttgaaagaattaagaaaagaagctataaaaaataaattgttcaaggattcttcctgtttctaaacaccacaagattatgatgatagagacatcatttgaagtggtagagagtactgtgaaatatctatatgtgaatgtaatgaaaatgaaaaaataatctgatgaatttttaaaattaatcttgttagagtcatttttgagaaattgtatgcaagtgtattgattgaaaatgaccttctcattcaagaaaaatttattgagcacttaccaagtgtcaacaggtgaatgtgaataaaatagatatggtccctgccttcttggagttgaataaaatagcaaacacttattgaatatttattatatgttgtgcattataatattaaccaatgtttattgagttgttattatatgccaactatgccaatcctgtcctaagcaatttatgtatgttaactaatttaatcctcacaataaatctatgaggtaggtactattatttctgtcataaaattacaaaggcatagagagataatttgtctaaggttccatagagtaagtaggggacccagaattcaattcaaggagtctttttgttctgcatgacatctcaactgctatataaatattatttagttcccagggcaaatttttcaggataatattcttattctctcaattttacagaagagaaaactgcagtgtaaagaggtgaaataactcaccaaaagttaactgacaatgatcctacccactacatcacactgcttaactgggaagacacgcaatttaacaagtaccaaccaggctccacatttaaactctgaccccgtttgaccttaaagtaatgcatttttcttcaaagcagacacttcgccaccccaaaaaaaaccatatctgaaaagacataatgtacttaatcaatggcttcctgctataatcaccacaaccacatcctttcctagaatcgtatctgtcttattgaatccttccattagcttttctcctatacatgaagttcaaatagcacacctgagtttttgagggcatacacaacttacacattccaggctcaaatatttttttcctcccctgactcatgaactttttgaaatttaacagtttcttctatcttttatgctacctggtctatctgaaccaaacatatatattttgcagtttcctcctaaaatacattcaaagcactgttttgcttcgcattgctgatatttaactcctttgcaatatcactgctacttatacacaaacaaaaatctggtgttttttaagaggaagccaaactaaataaatcattttaaagatatatatatggttgggtgtggtggctcatgcctgtaataccagcactttgggaggctgaggcgggtggatctcctgaggtcagaagttcgaaacaaacctggc

SEQ ID NO: 913 - DNA, 3861 bp, Homo sapiens
tttagggacaagaatcagattcagaaatctctagataataaaactgaaatcattattattttgtataaatatatctacattacttgcttatttaataaaggaatacatttttaattttctaggctattatacatgaaatgttgctttggcttttgctttaaaaaaaaaaaagtatttggtaacatgtggacatttactaagcaaatgtgatagcttaagattgagggtagccacctgtaatcccagcactttgggaggccgacacagccagatcacgaggtcaggagttcaagaccagcctgaccaacatggtgaaaccccgtctctactaaaaattaaaaaacaaacaaaaaaaacgaaagaaaagaaaattagccgggtgtggtggcaggcacctgtaatcccagctactcgggaggctgaggcaggagatataattcctcaatttagccttcccacctcaatacagtctgataacagacgagcctttattagtcaaatcagccaagcagtttttcaggctcttagtattcagtgaaacctttatatcccttacggtcctccatcttcaagaaaagtagaatggactaaaggtcttttaaaaacacaccttaccaagctcagccaccaacttaaaaaggactggacaatacttttaccactttcccttctcagaattcaggcctgtcctcggaatgctacagggtacagcccatttaagctgctgtatagacataacttggcccatgatagctagtattcagttcttccttttatgcacaaccacagccagcaggaagctaccagagaatatgcaccagtgaaataaggttgtaaataaaaaagatatgcaatccatgaaacagaacatccagccaaggatcataacagcaaatgccagctctggtgagcacgttatattgaaaagggtgtgactgtggtgaaagacttgccacaaatcatgaaacaaaaccaaccagcactgacagatcatttaaaatgtttaaatacttctttgtttgacatttaaaatgttagtcacgtttctgcaattttaccgcctgaaaatatgttcactgcaaaattttggcataaccaaaagcacatctggaagttacatttctcaataagctaaaaataggatttagggttaacctgaagtgtgtcagcaattctctgagaagggtggattagagtgctcctaaataatgctgaagtgtttacaattcaaacacacctgaggcatctcttcacatcctgttttcctgtaactcttgtgatctcctgggcccttgtgcgtcacctgggttggaggattatccatccgctctttctaaaacatgctctaaaaaatgtcttaggaaaaacactatctaaagtcgtttataagctattcaaatttttagtaaaatatcaatgaaaagactttctaaatgcctgccacatgacaccttcgtgtaccaaaacctatcaaaattacatcttaaagtcattttttgttttcactgacaggaccatatttctcttgcagttgtgtagtttgcaatgccagatgtagggatgtcaatatttaatggataaaaatatattttataaaggagcccactgggatcacttctaaaggcaagaggggaataacagacaatggggcgtgcttgaggctagagtgtgggaggagagaggggatccaaaaaattaactattgggtactaggcttagtacgagggtgacaaaataatctgtagaacaaacccccatgcacgagtttacctatataacacacctgcacatattgccctgaacctaaaataaaattttaaaaaaataaatactctatagtaaaatcaaagataactataaacataatattttggtaaatgagttaaattactgaatagtctagtgtttagcaaaaatttacaaaaactatattttccactttgactttaaggataatttaggagattacatatgttgcttattactgacagcaagagagattattattttgagattctaatctttaagtattcttatttgtagaaaagtattaaaggtaataataaaataaaataatttatttaaaggaatttttagtacgtatttgcaaagtgaggtatctctttacaaacagttactgtactaagttgtgtatgtctatgtttacatttgtaggtcttgtttttctaaggctataatgagtatagttaatcgataatattacttttgcttaaaaagtaagttaagtcataaagatatttaaatgtttggaaaacattcttatgcatgtatctacactgttctcttttcctgtgctcttcatttctttatggaaatctgaattttatatggatagattttcaatgtcaagtgttgatcaagaaacaagtcaccagattatactttaaataccacaggttcaatgtaaatttaataaaaacacttgtatataagatatacgtatctattattaatgaatatataaggaatagaatttaatattaacaacatttagaaataaacagcctaagttaagaatagtgatgcttgggagagtgtgaaagggagtggaacagaatgtgggaagaatttttaaaactattttgactgtgtctgtaaaatttgtaatttttattaaagcagatttagttaaacatgttaaattttaatgttatttttaattctagttagaatatacatgagtgtttgttataatttcaccctcactacggggaattaaaacttttctcaaattaacatgaaaaagaacaaatgcacacatctcagcagaatcagaaaaaaaactaaagataaaagtaaggtatcatccttaggatcaaaagcaacagctttgcaaatgtgcacagaatgagatatgctataattattcatcacctctttctcacaatgtaacaactatttaagaagaatggtttagttattttaaaagagtgttttcgggttttttttctgcccaaaaaaaaaaagtactattacctttttttcctgggtttacttggtatataaaattctttttaaaattttatttttccttaagttattggtatacaggtgatatttggttacatgagtaacttctttagtggagatctgtgagatcctggtgcacccatcacctgaccggtatacactgaaccatacttgttgacttttatgcctcgccccccctcccactcttccccaaagtatattgtatcattcttatgcctttgggtcctcatagcttaagtctcatatgttagagagaacatacaatgtttgcttttccattactgagttatttcacttagaataatagtctctaatctcatccaggtcattgtaaatgctgttagttcatacctttttatggctgagtagtattccatcatatatatatatcacagtttttttatccacttgttgatcaatgggcattggagttggttccacgattttgctattgtgaattgtgctgctataaacatgtgtgtgcaagtatcttttttgaattacgactaaaagaatggtttaactatttaaaaagaatgattatcaccaaatgaatttggtgataccatcaaatgaatttggtgataatacatgacatgataattatgataataattttaaagcagaaatcagtcaatattttcagagagagattatacaaatgcaatttagactataacagtttagacttatatcttagagcatgttaacatgtggggaaaatgatctcttgtgtggttatttagaaagggaaacttttaaagaagaaagcataaatgtgggcatattctcatcttttacttaatgtaattagagtgaacatattgaagccacatactagaattttat

SEQ ID NO: 914 - DNA, 1387 bp, Homo sapiens
atggcaagtccggatagaagtaaagggaagacattaaaagcaaaaaaaaaaaaaaaaaaaaaaatgcccccagcttgctggaagcaagtgcagattctgaataagtcaaggcatgttgaagcactgaaagcagcagcaactgggagtaatgttccaagtggtaatcagaatttcagtcctagtgtcataactagcaaatgtagacattctgaaaatggtgcttcctcattggactctaataaaaatttgttactagagaaaagtaaagtattctctcagaattgcagaaaaccagtagaagaaatcgttcattcagaaacaaaattggaacaggttgtttgtccgtatcaaaagccaagtaaaacaacagattccccaagcagagtctttatacaagaggcaaaagattcactgaacacttccaaaaactgttctgaaaaccattttgaatattagacgaatgtaacaggatccctttttgagcagaaaggggcttgtagtctaaagtccagtttctgtccaccaagtttattgagtggtggtgttcagatgccaaagtctgcagcaaccagtactgtggataataagagaactgaccagatggttttccatttagaaacaaactccaatttggaatcacatttgccttttatcaaagaaaaagtgacaacattttaagttcagaagacttaggttttgtgcctgttgagaaaacacctaacttggtgaattcaggcacttgtaacaactgtgctgatgacattttgaaaactgaagaatctagtagaacctgtccttccagcatttcaaattgtgaaagtgcagattcaacttggcagtcatcacttgacactgataacaacaacagccattatcaaaaaaagaggatgttttcagaaaacaaagaaaatattaaatgcatgaaaacttcagagcaaattaatgaaaatatttgtgtaggtttggaaaggcaaacagcattcctggaacaggtcagacatttgaaaaattacatcaggaaattccagcaattctcccaatgctgaagttatggctgtacagaggaaacttgattctacaattgatttgacaaaagaaggcctatccaactgcaatacagaaagtccagtatccaccctggagtacctttgaaaactgttttaaactcaaagagcctcattggcacaaaatgcagcccaggttcctgagtcctttgagcacctgccaccactctcagaaccaccaccactaatacccgaattagtagataaaatctgagacacacttcctcaccacaagcctgagctcaaagtgaaatgggttttgagacccaggggcattgccctgactggcaatataaccaaaatcaatcccagtgcactcctgt

SEQ ID NO: 915 - DNA, 1871 bp, Homo sapiens
aaagtgcacaattcagccaggtgtggtgactcacgcctgtattcccagtactttggggggccgaggtgggcggtcacctgaggtcacagagacctgtaatcccagctactcgggaggccaaggcatgagaattgcttgaacccaggaggtggaggttgcattgaggccaagattgcgccattgcactccagcctgggcaacagagtaagactccgtctcaaaaaaaaaaaaaaaagcaagtgttcctcagcactgagggtttttaattttttatatgaaaagtctgttgaaggatatatgttagaagctgttgactgaaattttcattctagattattagattatggttttggattgcttattgtcactttttcatattttagtcaccgcccaggagcctgtctgcctcctgctgctgttcatggtgcccagactgttcatgccaagggacacgtgcaggccagcactgggccgtcctcagcctgccttggccctccttccgtgttcgctggcgcccaaaggctggaaggggccactgttaaaagtcgggttaagatgtggtcactgggcctgagggatgctaattgcctgcctccttcgggattgcctttcccaggttctggtcaacggggtacgagtcaaagtgatgtgggttctcttgcagtaattttatcatttctctatagatgttgacagtttctaaagtcctaccaggcattttttctaagtgaccttatttgggaggaaaaaggaatatgtgtcagaagggaaaaaatgtagtggaacaggaaggaaagggagggatactattttgctactccaaagtaattgatagaggattcctttggagggaggagtggagagggaatttttgcagttgttttccattctactgctttaaatcattacctttcatttaaactcatttaaatgtctacttttttctgatggattccactctttctggtcaaaagtattgaggggaatttgaaagacaagtcatcaggtaggcctggatttgatcccaacaatagttactgacttctagagctaaatcacatgcagagatcattagatataaggtgggaaccaggaatctgcattttaacaaattcctgaaataattgtgttcatgcagatggaccttgaaccacaattcaagacacactgttacagagaaacaactcttagagcttttattctcactgcaatcttttacttgaggatttggttaagatctaaaatgacgtctgaaagacagatgcttgctgtgttagaatcatgtctcctagttcactgcctttggacccaagatgtccaccttgagttctgtttccttagcttagtggttcttaaccccagctgcacattaaggtcccctaggatactttaaaagaaaataccggtgtctgcacttcacctccagaaattctgatttaattgctctggagtggggcctagatggcctcagtgatgttaatgtgctgccaggcttgggagcagctgccttaaactgagtctgaccctagatgtttcttggtcctattgcaaatccttgtgtcctttgcacccatccaagccaatgtgtcttaaggttacatatagtcagactcaagctggagcccttgttgaaatattatgtagtggggattattgtagagaaacactttgatagaaattgtaacatatgtaatttttcaagaaactgataagattattcaccacccgtagtctactcagaggctactcacctgtagccaagtgagtttaattcccttcaaaatagtcactttggggattgaggcaagtctttttaaggatgcttcaatttttcaaaacccatttggccttttctctgttttagacgttgc

SEQ ID NO: 916 - DNA, 3530 bp, Homo sapiens
actggttccttgcagctgtgactccccagggtaagaggcaaagagccaccaggtcccagctgaggaagccctgtggtcagctcagacagggatgcggactgaagccgaagcaggtgttagtaattgtcgtacctacagacgaggaaaccgagcctccatgaagtgaagtgactcacccacagtcacacagctaatatatgccagagcccacagcagaacccagacgtactgaggccaagttccatgccagcataaaacaggctccagttctccctggattccaggaacaccatctccttcctcgtcccttccatcccagggaaggtttacactgaaaattttttgtgatgaaaagatttgaagaagatgacaggagatggagaagcaccagctgatctgcagactccaaggaggtcccaggaagaggtgtcatccactaagatcttctgggacaggaaagccctgtgatacctcttacatcacaccaaacagagccccacaccaagaaaagagctgcccacacctcacagaagccatgttagtggacatttctccactctggaagccttcctgcgtggtggaggccagtgcagaccatcctctgcccagaagagttgcattctaaatgacccctcagagagccctctggatggccgcctctcccacaggtccctgcaatcacataaaaaacactcattgcagccaagatgcacaaagcacagtattgatttcatactcaggtttttccaaaacaaatcataaacccacaccaattatgtccaatcagttttatggataaagaagcctgagactctccaacaggagagcttgagtttcccttctcactcttgtgctgggtgtccttttcctacctccagaccatcacaaggatatctgtaatgtagatgaggccagtccttttgcccaatgttgacagacaagaggaagattccagggagaaatgccgcagcagcaaatgaatatgaatgatgcttttccactttgtgcttataaaatgccttttgtaccagaatctcaaagctctccaggaagcaaggctttgaatgggactttcactcggggtaaacatgagtggtcggagcttcccaagtcatttgtgataagaaagaacaaaagtccgggcacttttaaaatgcaatattcttgccttctgggtagtaaacaaagtgtgcagatggataatgacatctgtggattctggctccacttcctagagagaaaaaaaacatgtaaataaatacgtaaaaaattgtcatatgtggatgacacccttggttcatccagtagttaccattctgcctaacattcacgagctatggattctattactgggtcccttgtgactgcattacactgagaaagtaaaatatatttctcttcaatgcctgagggaagataaatgttatagaaatgtttagtaaaaaggtccagtcagtggctttgacacttgatgcttttgcactaagcagtgctgtccttttgttctctccattggaagcctccttgtaaatgtttaatagctaaatgactcaccagagtctgcaaaggtcaggcccttaactggaaaggcagaggggaactcagaagcagtctctatcagattgattggaaggttcatttgagaattctttccttctcatccttagtttaaggtgcacatgcagcatgaataactgcctgggctccagccaccgacatgcctgaacagcagacattagtgactctgacactcttcctaggattcattcagggtattaatcagcttcagaggaaaactcacaaacactctaagaagaattctgttgcaaaagtgatacctagcagagacagtctgcccttgcagtcacttgcattatatcccaaaagtcaatgctaagagcttgcaaaagaatttgagttcatcaggtgtccagaaaataaactccttcaaatgcagtcgaaatagtttcaataacttcaaatactctgcctgttatgaatctacagagcagcaattaaataattatcagttaatgattcaatgtcagatacctataaccaagggtgtcttgctattacactgaaaattacatattaaggttttgctggggtgcagaaaatgatcccccaaaatatagtgcttcggcatgccgagtactttgaaaatcggaaggttttagaaatcagccttagacccaagctctctttctgactttccttacctccttgtttctctgatcctctttctagaagcacctggagggactggactgactctctggaattttcttatctaacaaagcttctttccaaaaaaaaaaaggcaattgtcttaagaccaccccccccatctttaggaatctcatcaaatgaccaggaaagaagcaaagagacggagttgtcactatacccagatagactactcatctattctcgagggcaggtctgacaacctttgtgcaaggtgacgtttcactcctcaccttcccaacacctcccccagagctcagaggaacttttgtcatttactcctacacacctcatccccgccttccctaagaagagagggtagacaggcatctggaccctgctgggttattaggccattactcttctgcaattccccatggtatgcacgttaaaataaacgcatgccttttctcctgttgctctgcctttttcagttcattttcagcaaaccttcagagggtgaaaggggaagttttcttctttgtccctacattttgcattgtcttataccttgacatttttctactcgtcaagttaaactgtaaagcaaaatatagatcattagctgactaattatttttgagttaaaaagtagctagcatttggttttgggtaccacagtgtgtctaatatagtctttttagaagcaatgatctataaacattttttatcattcaccatttctggttgagtaaagtgactcacagttgtagtcctacctattcaggacgctgaggcaggaggatcacttcagccgaggaaggagttcaagtccagcctggacggtctctaaaaatattaaaatttaaaaaaaattctgaacatgcaaccccaatatgtatttatttgtaaatgatatactgtcactaatacattgacattaaacaagtagaaaacaatgtaacattttaatttattgactgataattagttctattttcattaatattttttaaaagagcaaaactgctgaataggcttcttttatttttgagaatctttgttgaaaactttgtggtgtaacagtttgaggtctccttccaagtcaagtttattttaaaatgtggttttaatggctgtcgtcacttaaaatatctcaaaagataagcaagcctacttgaaaaaatcacccggtctcagggtttactaaatcaaactgctcatttcggttgtatgcacaaatcacgcacaggttttaactgaaatttaattagttaaatttccatcttctttgaagtccatcagtcttttttttaacaaaccaattaaacagtatcaag

SEQ ID NO: 917 - DNA, 3944 bp, Homo sapiens
agcaccagacgcagctcctctctcctgatgggatggccctggggctcctggtggctctgacttctgtaaagcgtctccctccggcgcctttccctccaccagccggtggctgcacagtgccctgccttgtttctttcacacagaagtgagggcaggaagcaggctgtgccagctcacaccacccctaatgctcgcagcgctgactctaattgtttccaggaagatcgcagctttgcttttgtgctgttcctggtgaatgccatccgttgtctatgcacaaacatggggctgagagtaaaccacatttccttgtggaagcaggacttcaggatagccaggtccacgaacaatgagaaaatccggagcttcccagcattctgctcaaggcccagcatcccatatcggaacccgccgcacccactgctctctcagctcctgagcctccacaccctggctgcctgggaacacctcaggcacatgcaggtttaatataatcaaagccttcaattagggggtttagtccatatggaggaagtccagattctgcagatgagacaagcatggggagcattctgaggtgctggctttctgagcctgaaatgttcccccaagtggaggccacggccggccatcccactgaacagccttcacctcagggcagactcagtggcaccactgatttgtcactgaccgtcacgattccagctgaagctgggtgcagatggggtttcagctggaagaggttttccctttgggccagtaatcctataaaagtcatcatacctgtctggggagatgggcgatttccctagaatggagagtccaacgtgcaggagggagctgctcttcctgtcgggccttgggtgcacccctcatagggctcaggtcccactgctccagaaaggacctttaaacactcaggtcgagaagcagcaagatcacatttggtatttgccctagtcttaaaaacaataaacaaagcatgatagggagcccatgggcagatgtctgcaatttataaatgtgtgccctgaagcaccctcacccttctgtgctcatcacctctgagccccggggacatgcaccccggggaggccagccctgccctcactgccttctgtggcctctgccttccatctttctctctacatggacgcagggctaggaaacctagagactgggttctaaaagaaatagaaacctcttttttaccctgctcctgagagtcaacccttctgagctcaagcaaagggcattcccggtcctcagctccttgcccccacatagatctgaagtgagcctgtaccgcccacctctcagttctcaactgtcgcttaatcctgccccacaataggccacccctgggctacaacttgagcttctaggtgtgcacactgaaggctctgaacaggctcacagcccggggacactcggcaaggactccccacattcccagcacctgagcgaggcccagaaaagagaggggcaggcaccagattggcagctttgtatcctttctgcccacccccagggaaagggtgtagcccatatatggggaaggggggctggggaggccaggggctctgcaagccagggtccacgtcacttaggactgaaggcggcactgcccaggcaaatggcacctgaaaacccaacaggaacctggaggcccaaagcctccaggcgcctaaaaacccattcacttttctaaactgcatagtcccttatttgaaccagtaatgtccttaaaacctccagtgcagctctatctcggagggagtggaggtgggacctgggaaagccatccctctctcactccagatggcttggggccaccccttactgactattttcattctaaagaggttgcttctgtcaccctttcagcttctccagacccctctccttccatctttctctcttgtataatctaacctttcctgaacccaagcagaaatgcagtgacaaacccacaagatattcaagtgctggcacgcttctctctgcacttgcactttgcctgggctgactggcttctcaagggcaagtctaagggaacactggccagtgccacatacagactttaggggtcagggacaaagagatgtgatgtgtgatctacagcgtttctcctgtagatcaatgacacagaagacgccggaagggcaggccccattgctgaaacgtttgccaggtccaaatggttttggagcacacttgcaaactttcaaagaacagctaatttttgtattaaagtgtttcagagcacaaaaagatgggaagtttctcagtttattctacaaggtccgaatagcactaaaaatcagagagatactagaaaaagaaaactatagctttattcatgaatgtagatgtagaaatcctaaatgaaatgtaggaaatggaattatttattctaggaattaaaagatagctcattttgtttatacacgtgaggaaaataataggtgaaatgttaatattaactcatgttcataaggcatcaataacgcccaatcacattgctgttaaaatctcttagtcacttgggaatagaggacaacatgtttaattggattaaagtatctgtcaaaaattaataagaaacatcaaacataaaagtgaaataccaagaacctagcaccttaaatcagaacaagacaaggataactattatcacatctattattcaacactccagaaatccagtgttttgggggacaagagaagacatattacttaaatatgatatatttgcatcattagaatatagtcagaaaaccaaatctagtcagcagcctatttctatgaggttttattaggacacagccatgcctacttatttatgtattgtctgttatgactgcttttatactacagtggcaagttgggtagttggaactgagatcctttgacctgcaaagccaaaaatattccctgtctgactttttacagcaaaagtttgcctctcccaaaataattaactgaaaacaaaattaaacaagaaaatcagtagggtaagcacatagaaatataatcagtagtttttctacataccatccatcattaattagacaacataatggaaaagaattccatttaaaatagcaactaaaacaacaaaatatctagaattaaacttaaatgtgtgagaataatatgaaaacaaaaactaagaatcctttctgaggcataaaaggagactcaaaaagatatattacattcatggacatgaagacgatgttataaagataccaattatccctaaatataacatacattcaatgcaattcaaatgaaaatttcagtggttattttggggagtataagctttagaatttggaatctagaatagaaaatgtaccacagtagccaacaacatttggaaaacaattgagtagtgaaggaatgatacaaaaatatactatataaaaataataactaaatcagcacagtaattaacggaaacatagtttggaagcagatacgtgtgcataggaatgtgtccatgataaagaggacatctccagatgggggacatgacagactacccagcaaatgattttggagaaaacgcctatacatttgaaaattaattatggttctatttcacactctacccaaagacaaatttcagatggaccgaagatctaaacataacagccaaaacaaagtattgggtaaaatctatgtgaatatttttgaatctcaggaagaggaggtgatcctagtgcatagcacaaaaccccaaaggcataaagaaaaagatggacaagaaggaaatccaatgtttttcagtttttaaaggaaaaataactaaccactgaagaaaagccaatatatatacagggagaaaaactttaagatatatcaacaattaataccctaaaatgtgaagtattccaatgaatttgtaaaaaaattaaacactctattaaaacttt

SEQ ID NO: 918 - DNA, 1104 bp, Homo sapiens
gctcttcaccagagcctcctgactccccaggaccccagagaggaccgaccctctccagccgacctctgggctcaggacagctgggtggggcagccacaggagctgcctgtagggagcagagtcaggacggggaccgagccggacacccattctggaagtgtctgcacttccagactgctggccagacccccaagctagcccgccaggcctccatagagctgcccagcatggctgcgtccagtaccaagagttggtgggagacgggtgaagtacaggctcagtctgcggccaagactccatcctgcaaggatattgtggctggagacatgagcaagaaaagcctctgggagcagaagggaggctccaagacctcatcaacaattaagcattccggtccctggaggaaacatcagacaaacacagatggagggaccttcaaggactgacctgaactgttcttcggtgtcaaccccatgatagacaaaaagaggcagaggaactgttccagattaagggagactaaaaaggtatgacagctggatcaggggaaacgtgccttaaagggcattattgggactgttggcgaaattttaagtgaactgtatattagacaattatcaaggactacacgattgtatggcatcaacctcaaattccccgaacttgagcactagagtcttcttgttctgatggaatatgttctgaaatgtttaagggagaggagaaggatgcctgcaactgaatttcaaatggttcagggaaagataatagagtagaatagactatatagatggagaaagtaaatgtggcaaataacaattggtgaaggtgggtgaagggcatgaaagttctttgccttacaattaattcttctataagtctgaaattatttgaaaataagagaaatgctttcagctgtgaataacagaaagtctgactacttgtggcttttgcaataaagacatttagttatgtaacataacaggatttaagaggaagaaggcaaggacttgaaaaggctcagtgatgtagctgaggccccagattccttttatcattttgtccaaaggctccaccttcctgaatattactgctttataccct

SEQ ID NO: 919 - DNA, 2509 bp, Homo sapiens
gggctcagagctcgccgccaaggggcgtggcctccgggccgcggcggcctctgggagttgtagtcccgcctcaacttgtggtggcctctttaaaaaaacaaaaaacaaacaaacaaaaaaacactggcgcttgggtccgtcgctgcctcggtgtccctgtcgggcttcccagcagcggcctagtggaaaagtaaaagatgtctgaatatattcgggtaaccgaagatgagaacgatgagcccattgaaataccatcggaagacgatgggacggtgctgctgtccacggttacagcccagtttccaggggcgtgtgggcttcgctgcaggaatccggtgtctcaatgtatgagaggtgtccggctggtagaaggaattctgcatgcccccgatgctggctggagaaatccggtgtatgttgtcaactatccgaaagataacaaaagaaaaatgggtgagacagaagcttcatcagcagtgaaagtgaaaagaccagtccgatttaatagtgttgggtctcccatggaaaacaactgaacaggacctgaaagagtactgtagtacctttggagacgttcttatggtgcggcaaagccaagatgagcctttgagaagcagaaaagtgtttgtggggcgccgtacggaggacatgactgaggatgagctgtgggagttcttctctcagtatggggatgtgatggatgtcttcgtccccaagccgttcagggcctttgcctttgttccatttgcagatgatcagattgcgcggtctctttgtggagaggactcgatgaaaggaatcagcgttcacatatccaatgccgaacccaagcgcaatagcaatagacagcaagaagtggaagatttggtggtaatccaggtggctttgggaatcagggtggatttggaacacttctgtctacatgccttctcattcaagaattcgtcatcacgcatcacaggccgcgtctttgacggttaatgagaatgatccagaagggaggagaagctaatggtgcagtggagagcagagtccctgagcagtggaaacagccatgaagatctttcatctcttccaagcaccacctggtgtacctcgctggctgccgggctgaggtggggcaggggttacgtctgctcttcgatcctgtgattcaagggggatccattttcgtcttctttggtgtccgacacttcgctgagtcccagagaaggaatatcttcctcatatggtcctaaaaggcaccttggcttcctcttttcctctctggggaagtcacctgctacactgtgaggacatccaggcagccctacggagaggtccccatggcaaggagctgaggcctctgccaagagccagcagtgtgtgagaggcctgcaagtgaggctcctggaagccggtcctccagctggcaggtgacagaagcccccaccagtatcttaccgtcaacatcaggaacgaccctgagctagaagtacccagctaagccgctctcaaattcctgacccaaagagaccgtgcaagcctgagcaagatcagaggggagcattgccttgcaaccaaattcttcctctgcaataacgagtgctgctgagtaaggcattcttcaggaagatggagggactcaattggtaaaggagggactctggaggttctctatgggctggcagtaactcttgaatctggggaagaaggagagaaaggaaagagtggagaagacataatcctcaaggaagctgtgggcttaatttcttacaaatttcccttggtgcgtctgcccagagacccgggggagctgggtccttgtggtgagtggcttcctgggctcactggctctgatccctgtgccagcgtcccagggggaagggaagaggccccatctctaacaagtgtctgggggtatgggaaggaactgggggatcaggagccagacttctgggccaggaaaggggtgaagaagctcatctattttacttcatcccttgaccttcaaccccccaagtggcacctggcctacacagcagcttcccacaccatgaccatggactctgcctgactctggagtccaaagcccagccctgaggctggcccagtcaggagggtgcatctcctggggagaagggcaccagaaatggtacatccctccttcctcatgtgcccagcactacatgcccactatcttgaggttgaattcgctgattctctggaggtcccgtccaggtggggcccctgcccacatggttactcaggcaagaaatgtggacatggcagcactgccctgccatggttcttcccacctcgggcactagcctgggactattccccagggaatgcaagctgacatcccgagagcacccccccggtgggaagttctacagaaacagatggcgttgccagggaagttccaacagctgtcttatatgttaatgcttctgaaactggacacatttcacattttgaaaccagcactggactcagtaccaacaggaataaagttttttaaaacgca

SEQ ID NO: 920 - DNA, 3489 bp, Homo sapiens
tcaagagatttaccttttcaagcacatgatgctttcattcctgtggcttggcagtaaaattttgaatcaggaaatgtgagtctccagcttcgttctttttaggattggtgtgagtcagctctgtccacgtggttgctcataggaggttgtgagtcagctctgtccatgtggggtgctcacaggagggtgtgtgtcagctctgtctgtgtgggtggtcacgggagggtgctgtctgtgggtggtcacaggagggtgtgagtcagctctgtctgagtgggtggtcacgggagggtgtgtgtcagctctgtctgtgtgggtggtcacgggagggtgtgtgtcagctctgtccgtgtgggtgctcacgggagggtgtgagtcagctctgtctgtgtgggtggtcacaggagggtgtgtgtcagctctgtccgtgtgggtgctcacgggagggtgtgagtcagctctgtctgtgtgggtggtcacaggagggtgtgtgtcagctctgtctgtgtgggtgctcacgggagggtgtgagtcagctctgtctgtgtgggtggtcacagaagggtgtgtgtcagctctgtgtgggtgctcacgggagggtgtgagtcagctctgtctgtgtgggtggtcacaggagggtgtgtgtcagctctgtctgtctgggtgctcacgggagggtgtgagtcatctctgtctgtgtgggtggtcacaggagggtgtgagtcagctctgtctgcggacctccgtgaaggccagtgaaatggacaggacaaggtgcttggcctgcggctggagagccatcttcttaccccctggccacatggttctgggaaggcactgacgctttgtaaaacttgcctggtgtggaaaatgatggcggtcatatgtagtaccttagaaggctgtgctgggagttaacgatataacatagcgcaaatgcctgacccctgggagaggggcagtgagagtttgttgaagttgggaagtcgaggctctcagtgaggtgcagacttttcctgtccaggaatgggagacaaggagctgtcattcactcaagcccttcgtctgccagcccctggcctgttatacaccccttttcaatcctgtaaggtaagtgttcttatctccaacttccaggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggtgagtaccaggccaagctgtgctttcctcctccacggcacagctcgggttggggttccagagggtcccagctggccctggaaggtaccttactctaggcaagaatgaacaggttccaaccgccagcatttccttagctctccctggacagcctccgagattaagagaccaaaaactccatgatgtgatataaatcagcaaatataaaaaacaaaatcttcactctgcaactgagagacaggacaggagtccaggggctcaggatgaggatggcatcgcgatgagagacagacgccagctggaacaccctctaggcaggccaccctctgggcaggccgtcagccacagttccatgtttaggaggaccttgacaaggtcattcataataaaattattccccggcagagcatcacttctcggagggaactgtgtctctgaactgtgttcagtttttgtcccggggagctctgtctggtgctcacctttgtacctgcagcaggtgcactgggcaccatgttattagtgtctcagagctgagttcatgtgcatttcttcacctaagaacccactcacaatgaccccaccccagctcctgcagacccggcagaggctaggacgtggctcaggagacaagtagggtctttagagaagccccccggtcactccctttcaagccataagttcccaggtcctcaatagttggctctgagtagaattgtcagagaatgggattttcttaaccatcacaatttccaagtagactcaggcctaactcccagcaatttgtatgtcagactctacagacaattctgtgctgtctatttttgctcatctttaaaacagccacgaaatatgcagcttcctttccctgagaaaatggcaaagaaaattcaacacagaaggccagggagggtgtgtggaaacgattcacatgttcaaaagatttatatgtgtagaagaaagctgtgaagtgtgaagtatattttctattgtagaatggatgaaaatggaataaaaataatatcctttgctaggcagaataaataacttctttaaacaattttacggcatgaagaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtgtgagttatcaagaccatcctggctaacacggtgaaaccccgtctctactaaaaatacaaaaaattagccaggcatggtggcgggcacctgtagtcccagctactctggaggctgaggcaggagaatggcgtgaacccgggaggcagagcttgcagtgagccgagatcgtgccactgcagtccggcctgggtgacagagcgagactgtctcaaacaaaataaaaataaaaataaaaataaaaaatataaaaaaaaaagtgtgtagcgcctccccctttactcccatgcaagacgtgcctgcttcccctttaccttctgccaggattgtgactttcctgagacctccccagccatgcttcctgtacagcctgcagaactgtgagccaattgaacatcttttctttagaaattacccagtcttaggtagttctttatagcagttcaagaaaggactgatacagactgtgctgtgagcaatcacgtacaagctttggcgtgaatgtgtttttgtttctcttgggtctgtgcctaggagtagaactgcaggttcgtgtggtgactctgtgttcacctttttgggaaattgctggactgtgttccacatggttgcaccatctcacatccttatcaggaaagtatgcatttccttggttcctcatctcagtggttccgatatcttcacatcctctccaatctttacatcatctatctttctcatctagccatcctcacaggtttgagctgatgtctcattgtggtttcgatttgtcccactttttacggaagcc

SEQ ID NO: 921 - DNA, 1532 bp, Homo sapiens
ttctatttaaaaaatatttttaatttttaaaccttattttaaactaagacacacacactagcctaggcttgcacagagtcaggatcatcgatatcactctcttccacctccacctcttgttccactggaaggtctttaggggcaataacactcatgaagttgtcatctcctaggataataatactttcttcaggattacctcctgaaagacctgcctgagactgttttacagttaactttttaaaaatgtatttactatactgtactttttgtcataattttagagtgttctccttacaatacgagggcacatttgtttcctgcctatgatagtaaagataatgtcttcctctggaacaaagataggacagattttctagcagtaccttacatgattttgagtttcctaagccctggattccacagctgtcccacaaatctattgtgtgtccacttgagttcacttctgcattgccccctatgggacttgtcaggagaggaagcaaaggaagtgcagtgaacataaagctctttgcaggccactgttacataagtaataaagttctttgtctttaacccaggaatgtcatgtcttctactagcatctatgaaactgtaaaacgctaattcattagtttgaaagcagggtaaaatctgaaaatcatttttttgacataggcagattatagtctttctttaatgcctggtaattttgtattaaatcctaaattaagtaatacattgttcagtgctatattaaagtatttcctttaaataatttttgtttgtgaagttttccagttaaatttcttggaatgtgttgtatttgtacatccatcaaggtgatgcccttcagaagactctatagaatacagattacaaactcttctctggttgatggcaactttatgtctagccctgtgtgagctctggaagttgtgtaatctacctcttactattaaatttttcacttgagttcagtggtttccgctgaagtatgtgaatattagtactcaggaaaagactaaaaaggattcctctacatatctccagaatctctctgggcagctaccatctttctagtcccttacccatgaattctagtcgttttcactcagggataccacctgagtgttctgtttcttcaactcagagagaccaccagcctatgtttaggctcccctcctcactctgtgacccacaaacttcttccaggcaatacaaaatggggagaataacaaggctcatttcttttgtttcttttctgtcagggattatgatccctgtgcttctggttgtccaatgtttaaaatccattgttttgtatattttgctcagttttttagttatatacagcagaagagtaaattgagtctccattacactatcattaccaacagtggaagtatacttgcatttttagagtttaaaaaacaattttgttactatagaaatagctttagatatagaaaattgaattatttccaaaaaataaagaatggaagacaggataaggaaaaaaacacaattct

SEQ ID NO: 922 - DNA, 2155 bp, Homo sapiens
aagactgttaatgtaaagcacgaggtacattgtaggtatatgagaagtgtttgttccatcacctcttatgtcttcctttcttctgtcaaagcacttcctaaaccaaaaaggtctactcagatttctggtgttactgtttttatggttttgtattgttttcagcaatgtgaggaaagtggaatgaacttggactttgaaggcaaactaacctggaatcaaatactggctctgctgtttgcaagtgtgatctttgggtatgcttcctaatctgtgagcttcaacttcctcctctgtaaaccaagatcaaagacaaacagggaaacctacttgtctggtgcccatccccttggcagaacactcctctgaaggatgacagtttggctgtgccagggcagagctgccgacaccaaatgagccttcatagcaactatctgatgaggaactcactggcctacctttccttgacagctggggcctgccagccttgaagcatgactccacaacgcccctacccaaggccatggaggttgctgctgatgagcaagctgttttatatttaatccaggtttctgcttggagaggaagaaggtagaggagccagcgaaggtttgtctgaatgatacttgcagaaaaaacactggtaacagtcacaaaactttgaaaattaaagtgccagcgaggtggcttttggtggccagatgaaagctgttaaccccagcttttacaaatgctgggctttgagtaagaggagagtgtctttctggaaaagtttgagacctcttactattgtagcagcaaaagcatccacggctagtgttttccaagctcactgctacttgttgcagtctagcagtgttgtgtctcctgaaattcctacctttcttgatggatgtaaaagaagtaccaatttattaagctcctagtatgtgccagatgctccatatatgttacttttgatcttcagaaccactcagcaacttactgcttctcctcactcccaattacatagatgatgaaattgaagcagagtagtttgtctaggattacagagctaggagggaccagagttgggattctccctcagttctaatacacagtatgctacatttcctgtcgagtagtaacaaagcttctaagaaatctgagttttcatttgttaaaactgaatttttaagaaatgtagacaggagcactaagtactctatagtttaacgttaataatggtacaagtatataaccagtttctcatgcactggcataacatacttcagagggtacaccagggctggatgaatatctgaacccaaaaatatctgagacaggtctcagttaacttagaaagtttatttttccaattttgaggacatgcacccatgacacagcctcaggtggtcctgacgacatgtgcccaaggtagttagggcaaagcttttttttatacactttagagagacaggagatatcaatcaatatatgtaagatgtacattggttatgtccagaaagacaggacaactaaagcagggagggggcttccaggtcttatgtaggtgagagataaatggttgcattcctttgagtttctgactagcttttccaaaggaggcaatcaaatatgcatttatctcagtgagcagaggggtgactttgaatagaatgggaggcaggtttgccctaaacagttcccagcttgacttttccgtttagcttagtgatgttggggccctgagatttattttcctttcacacttcttccattttctttttaaaaatcttttgaagaaagcattttagaagaaaatgagtctctgctctcatggctaggatagtttattcctacaggggtaggtcccaagttattaggaaagctcatttttagcagattgagaagtctcatgtcctgtgaagagacaatagtaggaggaagggagaaaaacaacaaacaagagaacaatcctagaaaatctatatagaccacattactttgaagtccatacatcagtaggtaggtatgaaagtggcttatgtacctaaatagtttgcttttattttcttctgaagtttaagttgtctagattcagtttgcaggactttagaaagtacagcttagttttcaattatttcgaattaggaaaaatggggtgaggggaaggaaa

SEQ ID NO: 923 - DNA, 18682 bp, Homo sapiens
cgagtgaggatgagagtgtggatgtggatgtggatgcggatacgggtggagctgctggggctgaggctggggttggggctggagctgcggctgcggctgcggctgcgaggggggctgctgctggaccaggtgctgctgcttctgccgcgtggatttgaccgccaggatggcctgacgattcttgtactgcaccatctgcagcgtgatctcggcgttccagccctggtcttgcgggcaccgaaagtcgatctccttgccctctgccatcaccacagtgaagtacatgtacttgcccttgcgctccacacagtccacggtcttcatgttggagaagtgcagttccttgagcttgaccggcggctcgaggctggcgacagcggggccactgggttgggacggctcggccggcccctgcccgggctgttgttgctgctgctgctgctgctgttgctgctgctgctgctggtgttgcagctgcttgggcgggataagcagcagcccttcctcggtgaggatgcaacactttttcttccagagctgcaacaacccgtcgctgcgcttctccagcacgccctccttcagcgctttgcagccgctactctccagcatcctcccagcataagaggggccgccgcttggctcggcctctccgtttccagccgcgcgggccgggggcagcagcagcagcctcgcgccgtcctcgccccagcggctcccacggccgcctgcccggagcgcgcagaggaggctaacacgcaggaggcagagcggcggcggcggctctgggtcccggcagagggacagccgcgtcctgatgcgccacaaggtcccggagctccgagctgccgggcctctgccgtcctcttgcgagcgctcactgaagggcactggccgggccccctcgcggcgcttttgaatgggccatcttccccacccccgagtgacacccagcggaaaaggcggctcctggcgcccgcaccgcgggggaaagcccagctccaagaggcgctcggcagccggcgcacgcctcattaacttggggcctttccaaagcccgctgcgtccacgccctccagcgtctcttgctccgcctctcgccgcccacttgcttccgcgctcgttcccctggaaggcgacccggacccgagccccggaaactcctctcctctacccagggcgatcgcccaaggagccctggctgcctgactactgccgacgctcacagggcgctgcgaggccatcccccgcgtcccgcttctccccggcccgcgggactctctgctaacagcctcagaaagtgaggacgggggcgcggaggcgggggcagcctccaggcagtgctgcctctcggttcttgggaattagcccgggggattcgcgctgggctccgagagcccgcagaaccagcgtcgtgtcctgggcgagctgggaggccggggccgagtcccgcgagtcccgcgagtgtgcctcccccggacgcctaggtaaacaactgagcgcacagaggccgagaggacatcgtgtcttcccacgcatattcgctcacggtcactaagtagctcttcttggaaagagggcgattgttaaagcaatagtgcgactgtcgggcttgccacgggtggagagaggcggacccacgtcaggtcgcatctcgcctgcttttctcgaccccgaccgcaggcgctaacccgtcttcggctttcttcttgacccgtacggtttgcaacgtctcttaaaacagtaactcaactctctacaaaccggggtaatatccggtgctgagatcccacactgcaaggcgcagttccaaacgtctggtcggcctcgcaggtccctctttccaaggcctagccagatcttggttttggaatctcatttatctgtgacctggggaatgcaatacccccagctccctcctactcctacatttaaacaatgcctatagaagccgcttcctgggaagtaaggcataaccgagacctagcctcccggtagggaagttcatccgtttagtaaacagccccaactacgtgcggaccctcacggggatacgaagaattcaaccagggctggacaagtcagagtgggccaaggacaagtgagcattccagagaatttctacatgaccagctgttcattcttttaagaggatgacattcttcagctcatctggaaaggatacttcctttaagtctgttattcacagtctccaagggcaggtgtagttgggaaagacatttcatatggaaaaacaaacttgatagggtaaaaaaaaaaaaaatgagatgtaatctggaggcccaagtcattttcttaggagaaactcaaatgtgtttggtgttatctaaccttctgcagtttatcagtctgaaacaaatgcattctattctcatttgaaaatgtctgaacagccaccaattttcaaaatcacccatttaactagagactttaaagcccagaatttgcagttacgtatttcagaatgatttagtaattttgtgagcagctcagaggttaagtctacaatgtctgactacggtgcattattgaaaatatcagtagtgtaaggatcccgtagattggtgataactttgctcttgttatttcaacagttaccaccaacagttggtgacttaacaaattaagagcatagttgccatatgctcatatttggcaaatatgtcaaaatggccatatttgccaatttttaagacaataaattcacagaaaatgcattacagaaaataacttaaaaaaaaaaaaaacaacttttgggccaggcatggtggttcacacctgtaataccaacactctaggaggctgaggtgagaggatcccttgagcccaggagtttgaaaccaacctgggctacatggcaaggcctccctctacaaatgtaaaaaaaaaattagccaggtgtggtggcatgcgccatgtagccccagctacttgggaggctgaggtggaggactgtttgagcccagaagttcaaggttgcaggagctaggatcgcaccactatacaagcctgggtggcagcaagaccctgtttaaaaaaaaaaaaaaattcagctgtatatgcaatgaaaacctacaagtcactgaaaagttactgaagtttagaaaactagccaacaaaatcattgctttggtaaacaaatttgaaatggctaattgaaagtacattttacagctggcaatataaagttatctatcagcagcactggacagttcattttcttctcttggataaagtttatcacttggcttcaaggacatcactcagttttcctttacatctccagtgtctcctctatgaggtgctttctcttctctccaaacttttaatgttggaatgccccaagtctttgtctttggctctcttctttatctacactcattcccttgttgatatccagtctcatcacttttaataacatctatatgccagagtcccaaatttatacccccaacttatatccaactgcttactgccgaagaataaaacactgaagttaaaaaataataaacataccaggcaagggaacacttactagtaaagccatttactgagtagttcactaaaggtttaagtctgaggggattttaggtcataggaaaaaaaaaaaaaaactgaaaaagaacactcggatggtcagaggagtctgtaattcatacacaataggttttaacaaattcctacatggaactgctccagtttataggttagaattaactatagtgaaaaacagccttcagtttttatcaattccaggccagtgagtgctactataagttgaaaattctccatttacacttctctacagtacggcttgtgtagtctaagaaatcaaacatgtgaatgagctcccaaactattttcctcactctaacctactctacctgcagccccctttctcagttgacagcaatcctctgtacagatgctcaaactaaaaaccgtagatcagtactgcccttacaccaggccaggaaaggcccttatccaaggccctgagctttaggattgagtgctttagagtcaagatgacatgtcaatctagagagcatactcattctgcactacactctaggtactcaagaccccaaataccctgcccagaatagccccagctgttccaggaaatgcattacatcatcattgcatgcactgatgtgttagggggatagggcagttcgaatatactggttatggcatccaagtaaatgtgcaggaggccccttgccatacagttcagagccggggtgggaagaaaaggaaggtggctcatgggctgagggtcagctctgcccgcaagttatattctggcataaatacaaacctggcttcccagttctaatgaaagtttgtcaagacaggcacattgggcatattttcattaaacagtacttttaaatatttaaacatacggtatctccattgtactcttgccccaggccttcaagtgtgtagaatcatgcctgccttgtagtaatttttttctctcccaatatttaatctacacatttagtcaggaaatcctactggttaggccttcaactacatctggattctgtccacttccttcattaccaccctgatccaaatcaccatcatatccccccactggattactatgatggcctcctaacttgtctccctgattctatccttgttatctattttcagcatagcacccaaagttatctccatcactttcttcaagtcttggctcaacaggcctatcctgatcactctcaaatggtagccactcaattccccttaatttttcccatagcatatattatcttctaacatgctactcaataatttattgtacctattgcttatttctgttccccttcccactagaatagtatgcaagctattcaagagggcaaggaccattgtttctgatgtgtcccaatcacctagaaaaagtcttgataccaagtagatgctcaacataggtagaaatcttgaattgaattagaagtccatacccatcataaaaagaatatcaattttttcaaatgcttttgacagatttttcatgatgcatcctactttttaaaacttgagatgtaaggacttgaaatttgccctacaaacatatctctggtatactttttaaatggataactacatgctaggcctctctgaatcttaaatgcttttatagtcagacatctaaaataaatcccacaaaccttttcccaagcaacatgcaatttaatatcatgagaggtgtttatataaactagtatcctactgttttctagtaagagtatttagaagcatgagaaacacagtaatggaactgagttggtaagtttcttacttggcagttacatagtcaaacacttgactaaaagtccattaatcaatactggcttaaagacatgtaacagaacttggaaagttattaagtgtttaattcataatgattacaaaattctgatctgtaaaccaatttgcaatatacagtagaaactcatgacaatgatcattattaaagatttggatagaccaaaggtcaaacatctttcaagaaaaagttaaagcccagtaaattatgaacatgtcacgttaccctcatcagggtataaaagataaccaaggctgggcgcggtggctcacgcctgtaatcccaacactttgggaggctgaggcaggcggattgcctgaggtcaggagctcgacacaagtctggccaacatggtgaaaccccgtctctactaaaaatacaaaaaaaaaaaaaacccacagcgcctgtaatcccagctactcgggaggctgaggcaggagaattgcttgagccagggaggtgaaggttacagtgagccaagatcacgccactgcactccagcctgggcaacagagcgagaatctgtctcaaaataaataattaaataaataaacaaatagtctcacagagtgcagtttagacttcttagccttatttcatctttgaagtactattcagaagaaatattctagattctagtttccaaaagtccttgagttgaaaacgttaagtattaacacagaactatccagacttcttaggtgggtgtccagagctgccttccttttcgccttagtagttgatgaactgatgcctcctagtgaccaatctgtgtaacagcttaaagcaagtgctttataatgagtgcttagcgcttttttttaactgtagtacaaacacaattgtggatccaagcaccgtccatcagctgtctccgtcctttctgttctgccagcagcctaattcagttctctcatctaagttcttgggtggcccaatcacctgatccatactcatacacatggccttcagttttactcttaaaacatgacagaaaacttctattcgcctccaattgtatacattccaattccttacccttgcatgacaagccctccacagaatgggtcctacttattttgactcgttccactcaaccttgagcgagtgccagtcatacatctccttgtcctcgcagcctccaatttaccttcccaaatcctctgtaaacctttcattcttcaaagccctattcaaatcccagatttcctctggctgagttaattccttcctaatcacttcaaactctgatgagtagttatccaattttcacgtctacttcactaaatatccaagatcctggatgagtgttttcgccattgtacctaacggagagctgattgacagcacttaaactgaggggaaatgactaatgttttgtctggaaatgtattgatattattcaaaatgggcaagcaggctatcttattgagtattaacaagtaaccaggaagtctgattatttgtaaacttgttatggtaatattagctttgaagtgacaaacgaaaatatggaactggatgaaatggagcagagaggaaggtaatccaatgaaggaggctgagagaaccagtattatgttgtcacaaaactgcaatcactcaaaagtgttgatattctggctctgggtctctggggtgacaagataccccagtaactaagagtggaagcaatcctctgtccccactgaagagcccaagaacacctaccacctttcctaagtatgcttctactctgaaacccggtaaatgcaacccgttgtttgcaactcaaatatgtaactgacagtcacttgggcaaatacctccatttaaggaactaaattccaaggatatttccctcttttgctgtcatttttccattgccacaaaacacacagcctgaggacataggctgttcaatttgatcactattgatctctgtaagaaaaaaaaatccagtaatgggcaaatacctttcttaggtgatagaggacatatagcagtgagtgtagacaattcctcccaaaaacatgagaataaagaaggtggtagtggtgttactttagaagaacaactcaggcttcagagagggtaagtttcattacagacaaggtaatctaagagtaaaagggataaaagaattctgtggggtagccagactcagaaaggtggaataacacttttacaagaagataaaacccaggaaatgtttatggcaagcttgtatgttgccactaaacctaccagaaaaagaaatcccattagaaccgcccccatcacaataactacctaagtaaatcattgttgagtaacaatgagcaccccttaaacatgtcagaaaccagaaagtttttgtttctaatgagatttcatttacacttttaagtcattgtctcaacctaatttgtgcatgcatggttctgagaaaggttatcatgcaaaatgaaataaaaagccttgggcaaagcaggactccaatcataattaatccttttgggccgtatttaaagaaaattacttttcttagccctgttcacttatttctaaaatgtagttatttgctttatgttccaggatatccttgatcaaataatccttttctaaatcaacttatttcgacatatgtggccaatgtggctgtcatcctaacctcccttggcattcacacccagctctattttatttactatcctacttttagcactgtgagcataaaccataggttcttctttttacaggagaggttggatgccagtagcctttagcctccttcagcccatcctgtaccttgaacctggacatgatgtatagagccccagcaaccacttgataataaaccaacttgccaaagacaaaaagtagaatgaaagtctgcctgagaaccatgaagctcccatatcagtcccagagtctgtctaagcctaagagaaaaacctatataagccacattgtattggggctgtgttatacaacattataataaatacaaactcttcagggcaggggagagaaaaaggaaagattatctgaatattgtttaaaatgaaatctagattaactctggtctctaaaatatttcatctctgaaagctctagcctaaagaacatgcttatttaaccactagttgtgtgacagaaatatctacaaggcagtgcaaagtgtagggccatccaaatgctggctccaacacaactcaactgtgtcattgttaaagttacttaacttccatccttatgcataaaaagggaattaatattctcaatcaagtatgattaaggcattatttttattatcttaatgttaaacgaacacttagttctccccaaattgctgattaatactgtaaactgaaatcccactagtttaaaactatacatggaatagcaatgaagtttttctcgaaacctctcagtctagttacattatacccaacttttgaaaacacgtgtacttaagggtcaccttatacataccacttgaggttcctttactaatcaagcttgacatttttgtctgagggagttcactacgttatagcttgaattatagctggaaatcaattgtccagctataattcaagtaaaagattccaaaatgatggggaaaagcatatgtttttctccctgaacaggcatacaatatgtaatttaagctttgatgtctttggtcattttggaaaacgactgcaacaaactaagcccagtcagaaaaattttgcttgttttaagccattaagttttggaggttgttttgttatgcagtactaggtaactgcaactattgatatgccttcccttgactttaaaaaacaactaagttgactcttgaatatcaaatttgaactaagagggtccacttacaggtttacttctgtctctactacccctgtgacagcaagacccccctcctcctcagctattcatgaaggcagtgaggattgagactgttataatccagttccacctgagagtaaatatacatacacatacatatacatacacacacacacacacacagacagtttcattctgttgctcaggttggagtgcagtggcactatctcggctcactgcaacctccacctcccgagttcagtcaattcttgtgggctcactgcaacctccacctccagagttcaatcaattcttgtgcctcagcctcctgagtagcttggactacaggcacacaccactaccacctacagctaagttttgtatttttagtagaggcagggtttctccatattagccaggctggtctcgaacttgtaacctcaagtcactggcccgcctcagcctcccaaagtgttgggattacaggcatgagccaccacacctggccataatatatttccgattgcttaacattttctctagcttactttttacagtatataatacacataacatacaaagtgtgtgttaaatgacttattggtaaagtttccacagtaggctgtcaagttttgggggaatcagcttatacatagatttgactgaaggaagctggggcccctagcccctgcattatgaaagagctaactgtatacacaatccagctttgtttcattggttttctcaatctacaggaatatgacaactacaaaagaccttagagactgaactactgagaatcaatcattcgacttgctacacagtcccacacaggattatggttggtacattgaatgggtctagataaatcctaactgacctatacatccaaaacttttctgtacacttaccaagttccaagcacagtgctggaaattaggaaactcattaataagcaagtgtttctagagtattttgaactggttcaaaaccagttcagatttatagaaccaaagagtaggtactgatgaaaaggagatcctatgttgaactagtaaaacacatgcacaaaagcccagtggcagaagtaaaagaaaaggcagccaagcagagctgaaatagtgcaaatgcaggttaaatacagtgggctattcatctccaagttgccgtgaagtggctaagtccactcaccaagccaaatgaatagcaaagacaacagttccagcctccagttttgaaatccatagttaagtgcggcagctcccacttgtaagcatagcacctcaggaggttgaggtgagacaaccacttgagcccaggagttagacactagtccaggcaacatagtgagaatcatctcaaagataataaaaataaaactttgttgactggcctaatccaagtctaaaatcacatctgatctcaagacagacacccatgtcacatccacaccagtgtcaaggctccaggtaaatgttgggagatagaagggataacctgaataatgacaatttgggtattctgaagcatgagaaatccaaatatatagcgatacctcatttcgttttaccctagatcatttctgggttctgccaaaggccaaagaaagtaaacagcatatgaaaacacatgtattaaaataaaacaagaaaggaatgagatgagattttcaaacctagctcactttaggttaaggtcaattttttttttgttttttacacataaaatcttcaaaacgaggcatatgtttaattttattatccagtcttagtctcagtgttcttatgtacactgagtaatgcatcccttacacctaggaggaattttgcctttgaaccaagaaaaccccaactagttcagaaataaagttctaaaaccaatttaaaaagtaatcccaatcacaaattttaggttttcttatgtttaggaagtgctcataggctctaagtacttttgtttccttattaatgttcaccacgatctttcgcaatacagatgaaaagactgatgctgaaccaacaggtggtagacagactctaaagcctgtgtttaaagacactacccaaagacactacttgtattctcacacatatccattaaaatttggtagcagagacatttgtttaggggctgaaaagttttagtctaaaattagatctccatttttattcatggattcttattcctatagagcaacctcatctactttcctagttggatcaactgattccacttatttgaaaataattacaaatacggacggcagtagcagtaggaaaaataacattgtttgattcaacttcaaagtatccactgtgcgttcagtttttatgatacatgtacaaattttctttcacctgaaaggccctagaaataccctgtaaagagcatattcagcaactggacttaagtttctaagtaatactccctattctaagaagccagcaatccttggagaaatggcccattccagggctgaaatagaaaacgcctgtaagactagaaaactttttgagccaaaaagtatgttgatcagagtaaagaatataccggaattctttcaactattttcagagttgaaggaaagctgtaatattgataagttaccccaaaacaccaatctggagtttgactaaggggattcactgcagataaaactttattcagcaatttttttaaataaagcttttgttcttggctaagtaaattatcttaacagctaacagcgtcttgttcactgctgctgccacgtcatttaacttactttttcagttgcatatatatgaccctgaagcctttactggcccctggggcccacctacctcaaatgttctgaccttcaaatggctgacttggtctatcaatcatgtcttcctttaaaaattatctttcagccaggtgcagtggctaacgtctgtaatcccagcactttgggagaccaagatgggtggattacctgagtccaggagttcgaaaccagcctggccaacatggtgaaacacctctcaacaaatgtaaaaattagctgggcgtggtggcacgtgcctgtgataccagctactcgagaggctgattgcagcagtacactccaacctgggcaaatgaagtaagaccctgtctcagaaaaaaaaaaaaaaaaaaaaatttctacatggaatggtcatcctcatcctcacttgaaatactcttgtaacaggtggttccagtgttttaaacccattaagaggacttccacagctaaactttctatggactggccacttgtatttctacctgtatttccaggtatctcaattccttgaatgtagcctcaattgttctgttctgggacctttgcctgtatttcctcctgttcctccacctgaactgctcaccgttcagaggttcttcctctcacttcacaaattcctacagattctcaaaatctcagctaaaagctcatacaaattttgagccttctggtagcaactattttacaacctcatgaaatttaccagagccgcaattgcctaatacattatgaatgataaaattatgaataagaccttcaactctggatatgagatctgtcgacttctggcactcacgtttaatcacacattcctagttccttctttttggctttaagtttaaaacatgtaagaaactggctgggcgtggtggctcatgcttgtaatcccagcacttttgagaggccagcactttgagaggctgaggtgggaggatcactggaggtcaggaggtcgagaccagcctggccaacatggtgaaaacccatctctactaaaagtacaaaaatcagctgggctcagtggcacacgcctgtaatcccgactacttggaatgctgaggcacgagaatcgcttgaacccgggagatgacagctgtagtgagccgagatcatgccactgcactccagcctgggcaacagagcaagactctatctcaaaaataaaaataaatggataaaacatgtaagaaactaaaaagcaatgcttttatgtaatattttatcctgggtttcaaaataataaaactcagtttgttctaggatccacaaaacttaaaatgcccaatttcccataggaaaattaaacaaccagactgacttatttcccgccagtaatctattatttctaaataccccatttcttcttttattcagactcttggcttgaggatgacatggtcgggcctcaataagcccactgtaagtcaaaaatatcataagtagaagatgtgtttaatactccaataaactcataaagctgaagtcttaagtcaaaccattataagtcagggactgtctgtactaagattttagtgaataacttaatttttgtaaactggaaaacctgacaatatgatgtcaaaaggaagaaacacaagatacaaagcatactgtatttttgaaaatatacatcaatcaaaatttcttatgaatacttatccttgagtaaaataatttcatataccaacaaggatgtttccatttctgtaaagtcatgtaagtgatcctcaatcagtccaagaacttggctttttatccaggttatattttaatatctggagttttaatccagcatacaaaaatcaccagtatacatctattaagttaactgcagtattatttcaccatcaccatttacatgtacttttcaggtatcagagacttagtgctttaagtagcaaattacctaaattatgaacacatatttccaaaaacaaaatcaagctcataattaccaagtatatatgtacagtgcagattaaaaaaaaactgaattagcacatatttctcttttctaaagctcctatgaagaacttacactcttctgcactaccaatctattctgtacatttaaaataacatttgttttgatttaaagtcaaaaatataaaggcttaaatttttgtaagactaacccataaaaaaggactccaattttaaaccaatccctgaaaccaaagcattcaaatatttgaatattagttcaatatttctacatagcacgataagattttcagttacttcaagttttgtctttatttttaataatgggaatggcctacaattacaataaacaattaattcagttattttaggggccttaccatatcattaacctattcacacaacaaaaatatttttatgaaagttaatatatcctttcctgattaagtgtgctaaaacagaaatagaggtagaatcccatttttcttaagtaccactctacaagccagttccacacaattaaggtatttttgcaatctaaaatagtgatgctaatactgcttcagtaagctagatttactaatttaagaatcctaagaaattatatatgtggctttcagacatccatgttaaactatcaacttgtggaatttgtggaacacttaccctacttgagtgaccataaagcaaacaactctaaaattttttcatatcagttttctttataagtgattatatgatatttcaccatttctaacaggaaaaaatgagacttacttggcagtgtgcatgggctgctggaaactacaatcagagtgtaaagacaaatctcaaaaatgtttgtagataactcagaataataacccagaatataacctatcaggaactatggaattccattttagtcttcaaataataaactccacttagcagggattgtgaggttgctcttaaaattatatatttacagaacatagtggcctcagcacaaaatagctccctctagacatcactactctccactcttcaaaaaaaaagtatatacattcatttaaaaaaaaacacccaaaatatcaccagtacattttataaaattaaatccaaattttattaaggatttcaggttacatacttcaaatttctagaatggaatggaatcattttggaactggaaaaatggcataaacactgacgtcccttaaaacttcaattttataaagaaaattcttctgcaaaccacatcccctttatgtaacaagactaggtattatctacaccttcactttggcaatagctatttcctaaagaatgaaaaagatgattttgctacttcagttcattaaaaatgggattctatctttgaagttcagaaaaagctgcatttcgatgaactatggttaaaaaaaaaaagcacatagtgtctaatcaaagcaaaggaaatcattttgaaaataaagaaaaaaagctattataattggttaaggatttccagtagtaagttaaaatctcaggagaggaatggatagcactacaaacaatgtgttcacattccaagaccttaacactaacttctcagaaaggaagttttcattacctctaaaaatcaattcaatgtaattttattaagagcaggaaatctagaccttcctctaatgacaatccaataatccaccctcactgtcaaaaaaaagttcaaccccaaaattaacagtaattagcctgaggtattgtaaatgtggctctacagtctgaaatttaatggcatcttttgtcaaaaatagtcttatttccactttaagtctcatgactacaatactatagtgctatccctgtagtatttacaatacagtcatcaaaaatatctgaaaacaaatcttggaccttgtgaaatagtgcatccctccacttctataaaaataggagccacacaaagatctaaaaagagtgctgactgcccagatccagaacagaggtacttaacacctttgttttccagtttagttatcaaagcgtggtgtgaacaaaatgcttagtgtcacactggcattacaaataggcccaaaattttgagcttttaacaagattgagaaacattatatgagatttaactcaatatgccttaacacatccatgaggtagttaggtaaacagtactacccattttaattacacagtaaacagaagcacgggtaagtgacatactcatactttaagcaataagaattagaagaaaccatagaagcttggggccttctctctagctctaacccaaagaaaatgaatttttttttttttttttaaaagaaaacagcatcaatcacttaagattttcttcctcttttttttttttttttacacttgcttattagtatagcatctcgttccaaagctggtaccttttcttcaacaatgtgttaaaaactgagtataacccttaattcaaggtaggcctctacttctacctgaattggtacaaaattaagacattatcttgtaagaactaaaattgtatttgaaatttttattttagctgcaaaaacaaaaacaagcaaacaaacaacaaataacttgaaaataggcttgtcaaatgatgtaaattcatcctttccagggaagcagaaggtagaccctaccacaaagaaaagatgcttagttaatggaggttaaatttaaaaatacagttaaattcaggctaacttctgaaaatcccgttttattcacctcactgtggtaccagtaactatactgagtcaggttactttacagttaactatgtcacctaaaacacaataatccattaacactctaataacagttattgggtgtggtcatactggaaattcttaaccatatagttgtcttgccaattttttttttaaacaataaattgtcttagtataagtcactgcatttctgtaacaaagtaatgaaaggcacagctaatccaagcggacttaaccctattcaacaaccagctgaaaaaatactttggttcttcaaggaaaaaattacaaaaaaaaaaaaaaggtatttcctttaacagttgttaattttcatagctgtactccaagagctacataaaaatattccagaagaaccaaattatgtagcaatgaatgaacatgcgtgacagaatttgtgcattcaacatagctggcagaaaaactagttaaaatgctaggtagaacaaattggtctttaaaatatcagtttcctgtcctttaaaaaaaaattacctagtctaccaagaaaatacaaaaacataaggctgtaagtaaataagagttgtgtttaggctattacagtgcaggttatcctcaaggccacatacatcctgcttcactgctgcttgcactctgctgggttttgatccttctgttaaaggaaaacaacaagtcaatctatcttcttctacctgcttcagtgaatttctcaatagtaattactgccttaattataacagtagctcactgttgtcaaaagaaatggtataggacaatggtggtaaattatttattttattagcaagtcactgaaatgctaaaatcaagctcaaactttacactgtagaattaactccataaaatgtgacacacgctaaaccataatcttaaaaaaataaagttaccaagcaatttatgttagttatattaccaatcagctttgtttttgctaatcctaatataacaaattctcaggaataatagactaggactctcagggactgagtaagagtagttggaaggatctaacaaactgcactgctccccagttcccgaacactcctacaaccagatcttttaaaaacctttattttctaatgcttaaaaactgttacaaatcgtcccattaaaatagaatcctagggttcactgtacctgaaactataaaaagcacgaagtccaaacaaaaaacaatgttttttagaaaaacgtccactgaaattatgtgtactgttcacaatgccagtgggactgaaaaaacaaagttatccagtcaataggctttatttattaaagactttaacggagagaaacttgatattcaaaaacaccaactcttactttagctatcttaaatttaatagaaagcagcactaattttgctcacctttgggtcatagtctggatcattttcctcatctccttcttcttccccttcctatattaaagttcaaaatgcatccatgaagtatgtacatagtaggtaaactggctcataatgtagggaaaatttaatacaagttactctacggatcaacagattttcatgattacagactttgatgataatacaatttaatttgaaagcttctaatatgaaaaatttcccaacacaacttgagacatccagacagcttttattgaaaatagttactgcagccaacgttggaaaagtttactgcagcttttgacttcttcaaagagctgataaccctgcagcagaacaaaattatttgaaataaaaaaatgttgctgagttttgcaatttatttattgaaaccttatacatacattgtttggctgtagaattctaaaatcatgttttccaaaatgtttttatcccaaatcacagaatgattatagcaaaggaatacataagtcattcaatttgcttctcaatgtgttaaccacagagaattatttgctcatttggtaaacattacctcatccgcttcttcaccttcttcatcatactgaaaaggaaaaacagcgttaagtgttgagtgaatgtaacacacatttcagagtagcatcagtaac

SEQ ID NO: 924 - DNA, 2391 bp, Homo sapiens
ctcgccaccttccctggaactgcagcctggagggtgcttccccagccctgcttcctgaagcttccaagctcatgcgccgagacagtagctccggccaccaagatccacccctgcgtgtgtggcgtgtgtctgtgtgtgtgtatgcatatgtatgtacaggagctctaactgcaggaccgtcctcctcatgggtgacagggagctcaccagtcactctgggttgggaactcctagcaacattttcccacaagtaagatcagattaaagtaaagatcaggaagggtcaagagagaaaaacagccataaaacggtgggttgggaactcccgaaaggaccttcctcacacaactggcccagaggccgtgagtcacggaagacagctgcatctcatctggatcgaagagtcgatgctggtggcggattgtgtgtggcacgagttccctgacactcgctcaggacatgtcccgtggatagcttcctcctgaggaaggcaggcaagccgtccacccacccacgctcctgcacgccttgtgtcagagatcagctgtcaaatctgacacgcatctacggcgctggcgccaaggcctcagcctctcacgctccacgtcccttggcctctctggttgagctcagctgggacagccccctgaccccacactcacctacccccactcctggcccggcacagctctggccccatcgtgccacaagcaggtgggggataaagggagaggacacgtcaccaatatcaaagtcgagcacgtggcgggagcgtctgtctcatgcacgggagggctgggctcggggaagcagagaggagcgaaaaacgggatgcaggcaggaaccatggcccggaccctcagagccggagagcagccacgggccctggagtcaccttggcttcccctgcagagggatacacaccctggaggagattctgcctttcctacaacacagtgaaggccattaaaagctctggaggagggggaggggctacctgcggggacaccagatgacacgaagccctggggtttggcttcagtgaacttcttctcccagtgggaggaataccccaccactacacacacacatgcacgtgcacacacgcacatatacacacacacacacacacacacacacattcttgcacgagtgaaaggggatgtcccttacatcctttgacggcaaaagccctcaactgggttggggttccaaacacccatcagagccgcgtgaccctactggatttctcggtggcagcctgggctctaagcagatgagcttctgaaagccccgtactccctcggccagcttcgaacagccatttaaggttgtctgggtccaggaaaaaggccatctttggatttgctgggggccccagatcttagtaggaaggaagaaaagaacctcgcaaatccctccagtttcgtgggctcctccaggtgggggcagccaggtctgcagatacagagggaaggaagcctggaaatgaatgctgatcccaggggatggggaggagtcaaaagcatccccaaagtgcactgtttgggagtcctagacccgggacaggtgaagggcacctgtcttcagcctttaatgatctagggcagccattctctctgaaggctgagggagcctggaggggcaggagaggcaaggcaggtccctgtggtcagagagcgccttctggatacagccacggtttgctttcattatgcaaggcacagaggaatgtgatgctagacacagcactaccgccgagacaggagcgagacagtgctgtgggatgcccagggttaaaaaaagttgccgcggtggctcacgcctgtaatcccagcactttgagaggccgaggtgggcagatcacctgaggtcaggagtttgagaccagtctggccaacatagtgaaaccccatctctactaaaaatacaaaaataagctgggcgtggtggtgagcacctgtaatcccagctactcgggaggctgaggcaggagaatcacttgaacccaggaggcggaggttgcagtgagccgagatcgcaccactgcactcgaacctgggcgtcagagcgagattctgtttaaaaaaaaaaaaaaaaaaaagttgcagggaaactgcaaagaaggtggggaaaggacactcctacacactgtgggtgtgtgttgaagggggacagaccctgaactggggcagccttctaggtgtgcaggtacaacgaggcagtccctgtccatgtgcaaaacgcccagcaatcacccagcaacagcccttccagggctcttgtctaccaaaccctataggcctccacagggacatgaggatgaagatgctggggacagcatgagtcccacctcatctacaccacggagctccatgcagcccctccaaa

SEQ ID NO: 925 - DNA, 2693 bp, Homo sapiens
ctggttggctgagcctggggctttgtcaggcctgtgctacagtctgacttctcccttttcctgatcctctttccttccccttcccttcagaagacttgatccctaataaacatcttgcaccccaaactccatctcagagtctgcatttggggaaccctgccctttgagaccagcctggccaacacggtgaaacagtgtctctatcaaaaatacaaaatatgccaggagtggtggtgcacacctgtagtcccagctactcaggaactgagaatacatgtgtgtgcattcttcattctaaaattatctcagctttaatttcctatacagtaaatattgatagatatagctgacctagcaaaagttctttgaggtccttaatgactttacaagtgtaaaagtgtcctgagaccaaaaatgtttgagaaccgctgtaaaaccattgggtttgggggtaatttgtataagacgtctatacaaatataagcatgtaatcaaaatgttaatagtgatcatctgtggatgatgggattatgggaaatgtgtatagagatttttcccttttttatactttatctgtattttccaactttttataagaaatgttttgcttatatgagaaatatagctttaagataaagttgactgatctgtataatctttagaaagaagagagaaacctctcttgctctatgggaaggtcgctcctgtgggaaggtcttggcagaaggaaataaacatgttgaaggccattctctgtagccctggtcacctccatccagcgaaagtagcaaagggaccctgaatttccacctcctccacttctagagggcagtttggtcagctttctctcgctgtcctcttttcaaataagaaaaacaaggactctagttcccaatgtaaggatccactcagagaagcccccaaacaagaagtgagcaagagccattttctattcctgcctgtgaagaacctctagaagttgactgcattccagcagcagttgcctagggaacaccagtgacaaaaaggagccgtgaggacacactaaataactttagcaactatttgcatttggcagatgtagccaagggcagggccctgcctggctccctgtggaagccgcaggagccccacaaggaagggggggccactggaacagtcataggggagcagggaggtgggtgaagaagtgagggccttaactctttcattgcccctccccaagcctgctggggcaagggtttgtcccagaagagatctcctgggctttgtggaaaccccagagaaagtgcagcctcttccgggaactgggtcctcccacacacccacagcctacagccccccacccacccaccatgccccccagtcttgcttctgcttccgccaccagggaaggcaggtgacaggatgggctgtgagctccaggctcagccttgctgtggcagctaattgggatggtttttacctgccaggtgaaaagtctgcctggggaggggcagtcagctctctgtcaaccctgcttcctctctgtctgccagctctcattaggactaagccagtcccatggagccccaagaggagaagaggccaatgagccaagccgttcctgcctgtggcctggaaatcagagctgcttcgagcaagctctgcgcgggctctttaaggtgagccccagtgcctgggcttcccactctctgggtgggatggagacgagaccgaaaatagaaagcagcagaggcccagaccaagcctggcttttctcactgcccccttcaaaaagttctgctcagatcagatgatatcagaaatgattggcgcctttatttcccccctttgcttctagtcccccaccccctttccagtttgaccacatctgtaggctctgttgaaacagagccaacataaacaaaaacaaactgaaacccagcagccagcgagggcgggatgtgccacccatctgggcaggccacgtgcagggctgaggactgccaaggcacacctcctgctggtaaaaggcaccgtgtggagtaattaacctccagggcttggtgagtgaaaagcaccatgtaaccatgctgggtaattgaagaggaagagaggagcgctctcccgagtgaacattcaaatgtgtgcagcttgctggaccctctcaagcaggatggcagtcggttggccatgccccataatgtggctgtcatcatttgtcttccaaattgttgcccaatcagaatggcttcgggacccttcggcttctatgtatgcatatgtataaagagacttcttaaagccatgcaggatttgttgttttattttttagtgagaatgtccagagctggcgaaagcagaagagaaataaacactccggtagtctgctggtgaggatgacaactggtcgacatttctagaggccagttccggctccaacactgcttgcgtgtatctgtgaaagagacccaggtgccatgaggctaggaaggctgggatttcgcagctctttgcactgaaactgctgtttccttgctggtgctgctggagatgaaaatccaccatcctccagaaacccaaatctctcctggcaccagctcccggtggccagcaagtcctatcatcaactggaagaaatgaatgacatgctctccgcatcacactcacttagaggggtcacacagcaaagctgcttaagcccctgaagc

SEQ ID NO: 926 - DNA, 2105 bp, Homo sapiens
tagcagccttgtgggaaatattaaagaaaatatgcaccaaggccatctaataataggaccatgttttgaaagatgtttacatggtggtgcttcaggaaatggggctttgcttttaaggtttttgagtatggagaaatagtatcccagctctgcaataggaagatcaacttgcaaacagtttaaataggctggtaggggacagtctgatcatgaaaaagcaactaggaagctattataagagattgaaccacaatggaggcagcaggaacttaaatttcttttttcatttatacttgcctttcaactttttgtagttgcaacatgtactttcttattgaatcctacctctgtcaaagtggaaactttgataactcaaattgtcccaagtataaagtgatttcaaagttttctcatagtcgtcttgtgtttttcacaaaaaccaatttctataatatacttttaaaaaattgttaatcatttctgttcaacatttcttcagtctggatcttatccaatgtcttacgctcctcgttaaacaacaaaaaaaaaaaaaaaagaaaaagaaaaagaaactcacatctaagattaagttcagtaaaattttgattaatcagaaaatgctaggaatggcgttttcgttacttaacagtaacacttttgtggtttcagggtagtcaatgaaaatattttcaaaatatatgtctatatctataactggatataattaactcaatttaacatttatttgatgatccacaattttgaagcctttgaatgtttgacttcaagcagcaagaaagatggagtgatagtgggaaggtaaaggtgaagtggtactctgagggatcagtggttgagagggaagaggtaggaagaagagcttcacagaggaaaaggatcaaatccttattgttccatattatagatgtaagttactgaattctaagaaaatgctgatacttattttaaaaactgtatccctaatcttttttcctcatcagttccttatttctcataaaagtaaaattagaataaaagatccatttctttaagaattatggtgagattgattttagtatgttatgtaacgtagcaagtgatactgagtgcagggcattttaagtaacagctctttcattatatctcagctaatttattcaacaactattgaatgagtactgttatatgttaaacaccattgtaggtgcatgtgatatagctgtgaacaaaacatcaagaagctttgccctctcttgttgagacagacagacactataaataaggagaatacatagtatatagtttttagaatacatagcatttttggtagtgaaaattaccatggaggaaaggagtaccagggtaaggtggggttatgaagaagatcttactgctaatatgacatcaaattaaggcttgaagagagcaatcaagtcttatagcaactggggggaaaaggttctgaggtaggaatatgtctgataggtttcaggaatgtaaagcagctagtgaagctagaaaagaaggaagaggaagagaagtagcagttgagatcaaagagctaaagggaggccttgtaaactattgtaatgactgctttttattctgagtaacacaccactggagggttttagatgaagtgatctgatttttttcaaactaacaatttaattttaatattaccatatagttaatatacagtaaattcactcctgttagcacacagtcctgagcatgcacagttgtgtaaccaccaatacaaagtataaaacagtatcattatttcagaaaatcttcccatccccatttgtagccaactttattccattctctgcccaaccacggtcttctgtcttttttgattgttgcagaatgtcatataaatggaattgtatcgtacgtagcatttccatctggcttctttcactagcagagtacgttggatgttcatccatgttgtgtgtatcagtagtttgtctctattgctgaggagtattccattgtatgaatgtaccactgtgtgtttatgcatttcttgttcagttgagggacatttgaattgtttcaaaacttggtgattattaataaagccactataaatgtcc

SEQ ID NO: 927 - DNA, 6557 bp, Homo sapiens
cggggcggggcggggcggggctgggacccggggccgcaggggcggggaaggaggccgcaggctccggggtgccctggctcagcgcagaaaggacgccgcgcacaggtacagcccaggccgcccgggagccgcggtgggccgcggtgggactgcgtttctccacctgtctgcggtcccggcagatgctcccgcgaaactcactttctcacctgcgcctgtcacgccctgggcgcccacagcttccccctccttcccgttctctcaacctgcgctggccggaggaccgttttcacactcagagctcccagaaagatcccgggaaggctcactgtcttctgcagggaaagtgcagctgtaactggccccatccctactttcaggtacactattggggcacctggccgcgcggcgtggactctgcacgcctgggacagggaaaaagtacaccggagtaccgctcagtctttgcacagcagggaccgggctttttattctgggaaccttccgagggattggcgagggctcttctcagcatttgagggaagatcccatctcgtcacacactgctttgctcgagggtgcacagtggcccgcactcctgggtctcccagccctggaggatctggcctcaaccccgagaaaagattctttctctcccatttaccattattttgtaatttaaacgcgtccctgacgattactcatctcatacctagcagtacggcaacggacgtttgcttaagtgaaaaatgaaattgcgaccatcttccaacccaaaatggcaatctcatgggggcaaactataatctgtgctctctttagacgggagcggtcagtggagacttgggattggtgttacctgactgccagatcatcttcctttccttccaccttctgttcttttgacaaatacgcccagtgtctttatatgtccagtgctctccaacaaaagcaaggattctgctttggatcacattgcctcatcacaacctacagcatgtcatcttctcttgcagcattagagagagaaatcagccttcgactttgacaatattaaactacattacattgaaatttaacatagaacaaacaaaatgggatccaaggtggtgggtggctgaagggtgaattatgggaaggagcgatacagtctaagtaatacagcaaaagcagctaaaattatgagtggatttgaatctccccatttttagtaccacttgttgggaaaggcagcaactctttgtcaaaggttttcaccttatctggtacctccagcagctagatccaggatggggctacccacccctccacactcctaaagtgggtatacccctccagtgcttcaggacaactttgccagttttctctacccagtcctccgaaagcctcagagcctgctcagaccagagggcttagctgtatgtacagtactaaagtttagaatgttgcctctttacagagataccctcagattcattctgtaaagggagtcccagtgattaactgtgtctacttatatgaaatgataagaagaaaaatgttcaggaaaattactggaatttcttttttaaaatactaaccatatgataatgtgtttgtgtgtgtgtgtgtgtgtgtgtgtgtgtaagtcatacagacactacgtgaaaatctggcaattatccaattgaacagatcattggaaacaaaaaccacgatcagttaaggccctaagtgaactttttgccttaattttaagtaaatctgtttgcctaacaaaataatgtgaaagttatttgtgcttctattcaaaaataggaagtctaaataggcctatagcaagtaaataaatttaatcagtaataaaaaaacttccaacataaagaaaacacatgatgagatagcttcatgagtgatttataccaaacgtttaaagaagaataaatgccagttcttctcaaacgtatggtatgtggtgaaagcagaggaggggaaaagctgtcaatattctaaatttgctatttgtaattattataactaatctgagctcatgagactagtgttttagaaaagcagctctaggcaggaaaataggtaaaaatggagaatgatcttttaaaatagtgatttgtaagatgtttattttttatatactctttaagaaatttttgtaagctatcaactgtctcccagggggaaaaatgcccatgaatacgctaatgtaaaaatttctgcttacagtttaacagactgtaagtaaaaaaacctgaaaaagtttattctgttttaaggaaaaaaataaaaacacatgatgtctgaaagaagattctttgaagttcccaaattacagggtcttcatgactggaggcacaagagtaaaggggaaaggaaaaggaatttggagtcaggtacatttgcactcattctctttgtgcttctgggcatttaacctttctgtgcctgtttccttctctcaaaattggaaaaaaatagtacatatctatagtagattttgtgggtgttctgctcagatccccttggatttcttccacattttctgagcacccctcaccctgtttttgcctcctttggtttccaataccagccccaagaccaccacctgagagctcctgggacttttctttggaggaactgcccttagctaccagaccaccattgcccataggcagatagagcctaggtgcccctgagtagcacttagccaatgactgatggttgagaaccttgatctcatgttggataaatctgaggtacaacttacaaccagagctcctctatgggatcggactgaaaccatctcccactagaccattcctaaaatcccatctgtgttggcttcttgccctcctctgtcctgctacccctactccctttcctgtttctcctggcaacactttctttaaattgcttttgtagaaaaatacttgactcaagtcctgctgacataagacatcacattatagagttgatataagcatcaaatgaaacattataaagaagaaactagtccagtgcctgaaacagagtaagccttcaataaaacatatctaatctttttattctgaaactttagatctcttttagttcacataagcaaggaaaaaaaatttctctctttcactgcagaagaattttgaggaacatctccttgcctagattatttctgggcatagtattatctggagtgatcatatactatgaaattttcttctgtgaaagttcatgtctctcctaatttgtttttctgttcaccaaaattattttataaatacggcaagtactttgctttctgttaatgaatttcattttgtttctttcaaataaaagtaaagtgaggttatgaacctaacagcagagccccaaaatacacgaagcaataaataccattttttgataaaggtactaacaccattcagtggaaaaagatatatagccttttcaattatataaccacatctaaaagaatgagtttggaaccctacttcacactatatacaaaaataaaaatggttcaaagacctaaatataagagctaaaactgtacaactcttggactaaaaccttgccttaagtctttatcacctgggattaggcaaaggtttattgaatgtgatacaaaaagtacaagcaataaaagaaaaaaggtagataaactgaactccaccaaaatgcgtgcatcaaaaaacactatcaagaaaatgaaaagacaacacacaatggacaaatattttaaaatcgtccatcagaatatataaagaactcttacaactcaacaatcaaaagacaatagcccaatttaaaaacatgtaaaagatttaaatagacatttctccagataagatatataaatggctaataagcacataaaatgctcaatatcattttcattaggaaaatgcaaatcaaaaccacaataaggtatcacttcacacccactataattttttaaaaatgataatgaggttgtggagaaattgggaccttcatacattgctggtaggaatgtaaaatgataccaccactgtggaaaatagtttcacagttcctcaaaaagttaaacatatgatccagtaattctgttcctaggtagatactcaagagaattgaaacataaattcatacacaaagcttgtgtaaaaatgtttatagcaacattatgcataaaagttaaaaagtcaacacaaccaaaatgttcatcagctgttctatacataaacgcaatgtggtatatccatacaagggaatattatgcagtcattaaaaaacagtgaagctgaggctgacggattgcttgagctcaggagtttgggaccagcccgggcaacatgtcaaaaccccatctctactgaaaaatacaaaaattagctgggcatggtggtgcatgtctgtaatcccagctactcaggtggctgagctgagatcgcagccactgcactctagcctgggcaacagagcaagattttgtttcaaaaaaataaaacgaaacaaaacagtgaagcaatgatacatgcttcaatatgtatgaaccttaaaaacatcatgtcaagtgaaataagccagatataaaaggctacatattgtgtgatccatttacatgtaatgtccaggataagcacatccatagagacagaaagtagattaatgggtttgccaggggttagaagtaggggaaatgagatgtgactccctaatgtgtatggggtttcttttttggatgacaaaaatgttttggatagtgatgatggttgtacaatattatgactgtactagaagccactgagctgtacacttcaagacggttataatgatgacttctgtgtgaattttgcctcaataaagtaaattttttttaaataagaaaggccagattttttttgcaatggagtcttgctctgctgcccaagctggagtgcagtggtgagatctcggctcactgcaacctctgcttcccgggttcaagcaattatcctgcttcagcctcctgagtagctgagactacaggcacacactactgcacccagctaattttgtatttttagtagagatggggtttcaccatgttggccaggctggtcttgacctcctgacctcaagttatccacccccactcggcctcccaaagtgctgggattacaggtgtgggccactgcacccaaccagattatttttaaaaattaagaatctgcttaccaggtaagaattactacttagtccaaaactttgctgtggaagaaatttataaaatttcgacaaattttccaggcttgttcttaaaatatgaactatcagttttcctgttatcatataaacatcaacagattaggtctgcattccttcttcaagtctaatttcctcctccttcaatcttggttgtgccatatgtttttccttattgcatgtaggataatagagaagtaacgggggaaatggaaaatgaagaggagagatgaagaaaaggaaggatcaataaatggctgagaggattgagggagtcaattaaaaaagagagaaaggtaaataaaatatattcagttggttatgatttaggagaccgagttgatgggtccagtttctgtgtgggcagaaccattcttttttccataactgcataccaatgtaaaagacaaattaatttggggaaaatccaggaaaggaatcccagttggtcagggatcggagtcagaaaggtagtatgtggttggaaatggggagagtgacaggtactaatgttattgaaaggaagaatcagtatagcctggcgacaaatggggaggtcttgcatggaaagaaaaagttatttcctagattgcaatctttaggaagtatcaagaaaaataaaaagtactttctatgtaattaatttctcagttggttgttttgactttataccagaactcactatcagcactgacaatcacaattgtcagacaatttcctgaacaactatctcttctatctccatcattctaaagatagacatgtcttttaagcccaagacaggaacttcagcttgaattggggcccagagctggcaatttaaccctgaaccagaagtgtctttaatgagaatgtgtgctgttgaaacccgtttaggtttgtaaacatttccttcgattttccttagggctgtgatgagatattcttcttcccttgtacctcttcatacaataaaccttaatgagtgacggattcaaataggctcatttcttatttgatatgtgattttgaaaagtaaaagtgttaggatagagagtgtaaaggagcttattacattactctctttttttaaatatatatatattttttattatactttaagttctggggtacatgtgcacaacatgcaggtaacagagaatacttggacacaggaagggaacgttacattactctctttttaaaaaagttatttcaaaataaaaattttgaagctgagttttttttaattgttagtaaaagttaacttatgattgtttgtaaatagaagatatttatataattctagggatgcaaatataatcataaaatatgttaaagcttgggaaatgtatgtttat

SEQ ID NO: 928 - DNA, 1843 bp, Homo sapiens
ccagggtacagggcaggagcctggacctctttacagttgccttttctctctctctgtcccttctccatcttccgagctcctactcgcccttcaggacccagctcgaatgccccatctctgggaggcgccttcaatcttgggctgccccttccgtcacaccccctgtcccctgtctcctgcctccccttcctcctcacacaaagccacccccgcctgttggtggcctgtgtctccgctggcccagggctctcttgccgtggccaccgtgggttttggcctcgtgacccagtccatgcgtgcacagcgcaagtagcttcccaggacaccgatttcctccccggccgcagctgcttctggtcctctgcccactcccgggttctgcgccttcctgcgcccccggcctggccacagctcggtcaccccagaaccaccgtgtgctggggatttgtcacgggtttgtcctgacgtgtgaggtccagccggggtccccatagcctccctgtccccgtccctgtccccgtcaggcctcctgctgcgctgtggacagtggcttggcgccatctgctgggctggtgcctgtggtgccgccaagcgcaggagggacccagcggctccaggtctgtgggagactttaagttggggccgaatgtggtgctcgctgccgacgcagagcccccaagctggacgggacccctggccgtgcggctgggaacacctggggttgtcctacctttgcagggacagcgagccaacccctgcttggaaggagcactttccccaccgaggccggcccagggcgcgtgctgagcaggtgggttgagtgggtggaaagaatgcaacccctggttgtgggacatgttgaagcccaccccaacccctccagtaccgtccttctgtccctccacttgctggggctgggggccaaggatggggtcactgtggggactttatccagctggttgacttcagggtcctggcagggagtggctcttgctgccaggacagtagaggcctagagagtcctatctctgacaccagccaccttgcagggttcgggccagggaaggggaagggatgggagagaatggaaacctccagagtcattttaactggtcgttggacagagccagtgcgacttcaagttcaatgacaaaccccctctccatgtctctggggtggggtggggcctgtggccccacagagctgagccacccaggaggccagggaaggagacgcagtacacaggaggccagggaaggagacgcagtacacaggagcccagcatcctctcagctgcatggacatctctacccagacccttctgcagccacctccccacttacccagcaggagaccaagccaatccttttctgcgaaactgtgctggcttctgtgactgtcctgcaaccagatagaggcctgagggactctgcacagtttctgggctgaggcagaagaagccccatggcttcccctctgcctcctgcatgctgccttttagctcttagcacctgctgggagaagctggccccagcgtggacaagcctccaggagaccggagcacccaccggaaggaagggagggagggagggaggaagggccatggaggtaaaacgaagttattagggtgggcccaaatctgactggtgtccgtagacaaaggggagattaggacacagacatgcacagagggatgacaccgtgaggacacagggagaagacggcatctgcaagcccagaagagaggcctcaggaggacccaaccctgcccacaccttgatcttggacttccagtctccatgactgtgagatggtaaataaatgcatgctgttaaggccacgg

SEQ ID NO: 929 - DNA, 2919 bp, Homo sapiens
actggcccgtgacgcaggcgcggttggaaagaagctgaggactggatgtgcggaaaccaggtcagaggggcaggcaacagagtgggcgggaaggcggccgggagcgctatacgggtctagggaatcagtaggaagccggaggcgcggctggcggcgacagcgtggccggcagagcagggtcagcccaggtcgcccggggagtgcgcagggacgcgggcaaaaagcccgggacgcgcgccgccggggcctgcggggcctgcccgaggccgaggccccggttgggggtgcgggccggagctcccgctctgcgccgggggcaggcgtctgctggcaataccttcccaggagagctctcctcccggctcccgcttcaggaacttgtaccagaacgtgtccacgcggcccggctccgccccgtcctgcgccgcctcctcggccgccagctccacctccccgagccacaggcccggctcctgcagggccagggccccgtcgcccgccgcggtgccggccggcctcaggcggacggcaccgcgcggctcccaacgccccagctcgggccgcgaccccaccaccagcagctccggccgggcgccggccacggcgggtggcaccaccaccccaaagcggaagcgcatggcgggcggcggcggcgcgaatacccgggcccggagtccccgcggccggcaggcgcggcccgagcactaggcggccgcagcgattgggcggtggtgtgggagccccgggcaccggggagaacacgtgctgttctgcgccttctttgggatgcatcacgcggctcccgagcccagacttcgtccaggccggcgggaaggggtcagcggagccgctagctgcctctttgtgccccgcaaccccgcgggcggttgatttccacctgtgggcgctggggacacgcgaccggaagaaatggaagagaaaacggggttcggggagggaggaaaacttctaagccaggcgatcgtccagttctctctccaagagactggaaattaactttatgaggatcataaggaagggaatgacctctagacagccgccttctaattgtgaaacgggggaagatcttggacctggtctctggagcgctccctatcttaaccaagtcacttactctagcaggtctcaggttctttgtctgtaaaatgagggtgtaaaataatgatctttctagaccctacgagctctgaaggatctctgattggtggagatcacccaagacccggagctgatgcaaaacattacctaccattcccttgtctgaaaagccacatcaactttcttttttcaaaaactatatttttagtatgtgtaaagtaagtttggagtaaatactttcaagtccttttcaaggtcaaaacaaaaactaattctgtgactacaaatgtatgcttttttttttttttttgagacagagtctcgctctgtccaaatgtatgcatttttaatggagtaaattaaaaaaaaaaacctttgtttaaaatttactttcagcaaaagtcagcattattttttcaacttaaaacctttttgggttttaagttgaaacaggttttttagctgtctggcccaaatccaaaatacgtatatcttggtggggaacttcaatttgtctctgccataagacaaacgaatgtcctgatactttttgattctttaacaaaattatccttgtattcttaggtttatatattcactaacatttaacataacacaaatctgttacgtgaattaaagacacacaaaggcatttttaccagtgtttggaagtttgtgaatagtaaaggggaacaggccaaaatttcatgcgttgaggatataagtaaaacagaaagtgcaaaaatgtaaactacacaaactcaatctcttgtggaacaattagaaaactaataatacattttactcttgaatgttgatattccactcgaagtttggttggttgctaagcttaaggataaacactatgaaaaatgtgaagacagaagggctggccaaacacagctgattcggcagcaaatcacacattaaatcacagtggcatgtgagtcggtttattcaaattgctgttaaaagatattcttagagtaagtttaggaaaataagagtcatttggcgatgcagagaggattttgtctacagtggaatccagactccggtgaaagttctcattccttcaggacctgggagctaacagctccggactttcttgtgctccactgtgctgcctatgttgtgtgcttcccaaatggcattattcccaccagctcttccagagtgagttctgcccattctgtagaagaaacagtagcggaaaaattaaacaatatctttgctcaacggacattgtttcctttactcttctttcatcataaagaggttgaaataattttaaccattggaagaagtaaccctcttaagcccctaaacaaaatttgtaatagcttattttatggcaaggatttaaataaggtataaattggatagctgcactgtgtagtaagtaaaatgcaactggaaaggagaacaagaccaaaatagggcttaagggacatatatcaaggccttgatcatattttgacggtcagtcatttggatgtataagtattaaccatgataatatccattgagcctatattatgggccaggcacatggttttcgtactcatattatcttatttaagtctctcaccaatcctataaggtaactacaattgttacccccatttttagatgtgaggatacttcagcacaaaagggtccaatgaacagcccacagcaaggaaggggcagagccaggggctaaaaggggtgcattcagcttatagatatagatacagatataaattctgataaggaaaatctgtttcagaatgcatataaattctagcatatttaaat

SEQ ID NO: 930 - DNA, 22303 bp, Homo sapiens
agggcggaagccacgggacgtggagcagatggtgaggatagtggggaggtagcagcagaggatgacccgaggcaaaagtgcaagtgaagaaaagtcgccttgccgggcagaggtacgggaccaaggcgcctcctctgggctgaggagttagagggaagaaaatggcgccctgtcatgagggcgcgaggtccgagttgaggggagaagactgagggacacagaagtggccgaagtgagggcgctgaggtcagcctgagctgagagggccggcagatcacgccgcagccgaagtgaacgaactcgagtgagatggaatgttgctctgtcacccaggctggagtgcaatggcatgatctcgactcactgcaacctctgcctcctgggttcaagcaattcttcggcctcagcctcccgagtagctgggactacaggcacctgccaccacgcctggctaattttttgtatttttagtagagacggggtttcactgtgttagccaggatggtctcgatctcctaacctcgtgatccacctgccttggcctcccaaagtgctgggattactggcgtgagccaccacgcctggccgttccgtatttcctttatgttttattttgctgttatttgcctagcatattcaaggtaccaaattaagtattgattgatggtaatagtgataacattaagacttggagatcaggttaaagacagatatgcaccatgaatccgtaattgaataagacagaaggaaatttaattagcctttttcctgtgtccatagcagtgctttaataagaacaatagaaaagtcttttttttttcctttaaattgctaatccaggatgttttcgatgcttttatggaagtcagctaactaaataccttgagagaacagcaataccatcaaattacatctgtctgtgacattttctctaggatgggactaacaaatttgatctgtttttttttaatatgtattaattcacacttattgcattacaacaaggtttttgtcttcttagctcttctctttttcaggaaattactccaggatttgaatcatcacaagagattcaccagaggattttatacacttgggctgtggcagcagactaattacatcacagcactaggtaagataccgggagtccggatcctcaggacttatgaaaataaaaagcattactgtaatattagtgctatttattggagttatctatgaaaagaatcttattaatctgcttttttattagctcacttagcaaatatttattgcataccaactatgtgccaggcattgttccaggtgtttgggccacatcagggaccaaaaaagaccaaaattcctgtcctcgtggatctcacattctagtattcctttccatatgcattagcttgctagggtttccataacaaaatatgacagactgggtagcttaaacaacaggaattaaattttttttttttttttttttacacttctagaggctagaagtgcaagaacaagatgttagcagggttggtttctcctaaggaccatgaaggaaggatctgttccaggcctctgtctttgacttgtagataaatgtcttcttcctgtgtcttcacattgttttttgtttgtgtgtccgtgtccaaatttcttcttcttagaaggataccagtcatattcaattagagtccatcctaatgacttcattttaacttaattacctctttaaagatcctttatcccaagatagtcacatgctgagatatatggtgttaggacttcaacatgtgaattttgggggaacacagcccataatatcacatatgattactgtgtatccacatctttgtgttgtctgtgttctcctatccacatccctgagatatccaaagccatttatgtttacttgcaaaatgtgtccagtgacctgtaattatgagtgattacttttctaggtatgacttattattttgaaagttttactttttaattgacatataatagaggtataaattttcagggcacatgtgattattaaatacatttgtataatttgtaaaggtcaaatcagtgtaattgggatatctatcaccttgtttgttttttatttatgttagaaacatttgaattattctcttttcgctattttgaaatatacaagacataatttaattttaagctatactaaaaagttcttggttaggaaggattattctacttggaatgatgctccatctagtgttcaccatattctactacttttgttaaagttttaaaaatgaataaaggggaaactgtgttgaagaaggggtcctctatttaacagttaggttcttactcacagagcactatggattcatagtaaaaaaaaaaatattgtttcaaataccatatgtgggaggaaagagcggtctatataagacattacttttaataattcaagaaatatcgttaccatcatttactgtcaccaccagttacgatgtacttttatcccatgaggagactgagactgagtttagtcatttacccaaaatttcacagatcttggtcaggtacaagtcagtgatggagatattgtttgccctacatacactgtgtaattcctgaatttgaactcctaattattcagaataaataaaaagagacaaaaagacacaaacttgtcctgatgcactttttagatatgaacacatgtaagcatatacctaattgggtactgaagtttcccttcaattttagtacattttaatccttgtcttatattgaaatgttatctttttgttcagtattttatcattgttgatgtgctgtgtcagaatgtgtctgtccatcttagatagtaaatttataaatgacaggacttaatccacaaccaaatcagcatattatagtttatttcattgtatatcttgaatgaaattgaaaaatttaaataactatttaaaagtttggactttcctctttgtagttttaaaacataatttttgtttttctcttgtacaagttgaatggggcagcttgactgcttggagacatcaggaaagacttccagggaaacaggagtttagtaggataaacatggcttacaataggatgcttcaggaatacagaaaggtccttgtaaattcataggcgtgtgtcagagcttgacacttttgggtaaatgtaagtagtaacagtgcaggcagtggtgttgaaaaatgacagtggattaaaaggcatagcctaaacttaaaagataactatgaagctgctcaaagagcttaacaatgggagtggaatgaacatattggacttatcaaaatattatataatggacaatctaaataggcttatatatattaaataattgaattaataatgataatttctagaacagaaagcaccaagtccagatgggctcattggcaaatcctaccaaatatttaagaaaaatattgtaccaatgctctataatctttcagaagacagaagcagaggaaacatttcctaactcattttatgaggccataattactctaatatctaataccaaaatcagacagagacattagaaaaaaagaaaactacagacaaatatggcttatgaacatagatgcaaaagtcctcaacaaaatattagcaaatccaatccaatgatgtataaagataattatgcattatgaccaagtgcagtttattctaataatgcaaatctggttcaccatttgaaaatcaattaatgtaatctgtcatatcaacaggctaaagaagaaaaatcacatgatcatatcaatagatgcagaaaaagcatctgacaaaaaccagctctcattcatgatcagaactctcagcaaactagtaatagaggggaacttactcaacttgataaagaacatatgcaaaaatctttcagctaacatcgtacttaatggtaagaaattgaagctttcccactaagatcaggagcaaggcaaggacgtctcctttgaccaacccttttcaacatcatatttattggaagtcctagctaatgcaataagacaagaaaaagaagtaaaaagtatacagattgggaagaagaaaatagaactgcctttgtttgcagatgacatgattatctatgtagaaaatctgaaagaattgaccaaaaaaaccctcctggagctaataagcaatgataacaaggtggcaaaaataggttgatatacaaaagttaattgctttcctatatgccagcaacaaacaaatgagatttgaaattaaaaccaaaatcccatttacaataatacccccaacttaaatacttaggcataaaactaacaaaaatatgtaagacctttataagggaagttataaaactctgatgaacatataaaaagctaaataaaggagagagattccatgtttatggataggaagactcaatattaccaagacatcacttcttcccaacttgatgtatagatccaaggcagaccaaaccaaaatcccagaaaataatttcctggatattaacagaatctttttttttttttttttttttcctgaaacggagtctcactgtgttgcccaggctggagtgcagtggggcgatctcggctcactgcaagctccgcctcccaggttcacaccattctcctgcctcagcttcccgagtagctgggactacaggcgcccgccaccacgcccggctaattttttgtatttatagtagagatggggtttcaccctgttcaccgggatggtctcaatctcctgacctcgtgatccccccgcctcggcctcccaaagtgctgggattgcaggcgtgagccactgtgcccggcctattaacagattcttaagtttataaggacaggcaaaagacctagtatagcaaacataatattgaagaagcacaaagttggaggactgtcactacctgacttcaagacttactataaagctacagtaataaggacagtatggtatttgcaaaataatagaaaaatagatcaatggaacagaatagagagcacaggtatagacccatacaaatactatcaactgattttttttataaaggagcaaagggaatacaatggagaaaagataagttttcaacaaatggtgctgaacaaggggatgttcacatgcaaaaagatgaatctagacacagatcttaaacttcacaaaaatcagctcaaaatggattatagactgaaatgtaaaatgctaaactatgaaactcctagaagataacagaagaaaatctagatgaccttgggtttgaggtgaatattttagatccaacaccaaaggcatgatccatgaaagaaataattgataagttgtacttcattaaattaaaaacgtttaatctgtgaaagcactgtcaagagaatgaaatgacaagccacagactgggagaaaacatttgcaaaatacatttgataaaggactggggtccaaagtactctaaaaactcaccaaagaagacatacagatagcaaataagcatatgaaattgtcgacattgtatgccattagcaaattgcaaattaaaacgagataccactacatacatattagaatggctcaaatgcaaaacattaacaacatcaaatgccaaatgctggtgcagcaagaactcttcattcattgctggtgggaatgcataatggtagagccgttacacagtgccaatcataatccgaaagacaaaatcccaaatgccataatctcaaatgcctatgaagtgttcggttgtgtttttatgtttctcaaacaaacctcctttacaaatgtaagtaaatgtctttaaaaaattgttttttaattatctttccagaattatattgtgattttggtctatcaggatcaggatttttgggattttagactttagggattttgatcttttgggatttcaacatttgatattacagcatttgcaattgtatctttcaggagtatggcccaaaccccagccatgtagaaaacaatttgataatttcttaaaaaactaaacacccagccactgttgaaaatagtttgtcaatttcttaaaaaaactaaacacacttttgccatacaatccagtaatcatgagccttggtatttactcagatgagttgaaaagttatgtccacataaaacctgcatgcagatgtttatagcagctttattcataattgtcaaaaattggaggcaaccaaattgtctcttagtaggtgaatggatgaataaactgtagtacatccagacaatggaatatttttcagtgctaaaaagaaataagctatcagctgggtgcagtggctcacgcctataatcccagcagtttgagaggccgaggtggatggatcacttgtgcccaagagttcgagaccaccctggccaacatggcaaaaacccatctctacaaaaaatacaaaaattagccaaacgtggtggcatgtgcctgtagtcccagctacttggggggactgagagaggaggattgcttgagcccggaaaggagaggctgtagtgagccatgtttgtgccactgcattccagcctgggcacagagtgagaccctgtctcaaaaaaaaaaaaaaaaaaaaggaaaagaaaaagaagccatcaagctgtgaaaagacatagagaaatcttaaatgcacattgctaagtgaaatgagccaatctgaaaaagctatatactatatgacttcaaccatatgacattctggaaaagacaaaactatggagacagtagaaaggtcaatggttgtgagagattggagggagggaggaaaaactgtgaagaatgtagggaatttttagggcagtgaaactattctatatggtactataatggtgaatgaatgtacttatgtgtttgtcaaaacccatagaatgtacaacaccaaaagtgaactctaatgtaaaccatggactttggatgataataaaatgtcaatataggctagttgattgtaacaaaggcaagaggtgttaattgtggggaggctgtgtgtgtgtgtgtgtgtgtatgtatgtgtatgtatgtgtgtgtgggagcaaaagtcataaaagaaaattctctgcactttctgctctattttgctgtgaacttaaaactgctctaaaaaataaagttgatttttttaaaaagcatgctatcagtaagccacccagacttcaatctgtttcactcttgaatgaattcacatcaggcatcctttttacataactttaaattgatttttaagaatgagacttagaatataaacactgatgatcctgccagacaaaaaagcttcttgtaaacatatataccattaggaagcaaaagaaaggaggaagttaaacaaataaaagatacataacaaatagcttcatatttaatgaattgatcccagtatgtcatttgggactagctgaccataaaatatcctcctactacccttgaaatattttttcttgggtcttcagcataatagctgtggagctactgggtccagttactgtattattgggtgttttatgggtgctatttgtacactgtatctttattttaaaaacctattttggctgggtgcagtggctcacgcctgtaatcccagcactttgggaggccaatgtgggtggatcacttgaggtgaggagttggagaccagcctggccaacatggtgaaacctcatctctactaaatatacgaaaaattagccaggcatggtggcatgtgcctgtaatcccagctactcgaaaggctgaggcaggagaattgcttgaatccgggaggcagaggttgcaggtagctgagagcatgccactgcactccagcctgggtgacagaatgagactccaattcaaaaaaaaacaaaccaaaccaaaacaaaaaaaacctgttttgagaagtcagcaatggtcagttcaatattggccattaagtaatgcaagcattgtaatgtaaggtttgattattgtatttgtgttacctatcattttacagtactaaattcccataagccatgacaagttacctttacaagttacattcatgttttacctttctttatattgactattctctgtttatagagaagaggtgaatgagtgaaatattagctactataaaataatggctaccatgtccataaaataatagactgcctggtctactagatgccagtaatcatattaatagctttatataattatctcctttaatctttgcaaaaagtctgcattatagttctcagccctcttctaaattgagggaactaaggttcaaagagatcaactaatttggtcaaagtcacacaggaaggcagtacagagtaatagttaaatgcacagtctttgtggcctaattccctgtgttagtattcttgttccaccatttcctaaatctgtgaccttaggcaagttatctaactcctttaatgtcatttttctcatctgtaaaatgaaagactaagtgaaataattcatgtaaagtgctcagcacagtggctggtacagagtgagtacttcataaatgttagtggttattaaaagtaattgtatattacacagtcattgtatattctttttattattacaaataggtgacaacatggatttaaacttaagtctccctggccctgaagttcccttcttttcctttactcaactctctctgtgtaaatttttagtcattggtgaagagagaactgattctcctaaatggctttacctctgtgaaaaaacagatttgccagtttatcagtcaggttaggctaggtttgctgcattaatgaacaacttttatatatccttagtttatcacaaacaagtttatttctcatttccattttatgtcctatgtggcttgactgggagacttctttcattatagtcacccaggaatctaggctgagggatgctccatttgccgtatgttttatcatggccaaggcagaaaaaaagggaaatggtgacttctgcactggttcttaaatatttctttttagaagtgacaagtgccactgctgcttataatttcattggtcaaagccagtagcatgaccaggtctaacttcaagggctttaggaaagagaggagaattagacataagtgagcagcattaataactaccacagcggccaggcacggtggctcacgcctgtaatcccagcactttgggaggctgaggcgggcggatcacgaggtcaggagattgataccatcctggctaacacggcaaaacgccatctctactaaaaatacaaaaaaaattaggcaggcgtggtcgtgggcccctgaagtcccaaaaactcaggaggctgaggcaggagaatggcgtgaacccgggaggtggagcttgcagtgggcagagatggcgccactgcactccagtctgggcgacagagcgagactccgtctcaaaaataaaataaaataaaataactaccacagcaaattgaactttttgagtttcctaatttgatatttctctttttgatttctaaatttcttcttatgtgtatagattcacttggtaaaaacctaaagataacttcatagaaatagttctctttcagagaggtccatcggaattatctggatacagtttccaaaatgatgtgcccaggccccactcaagacttaatgaattgaaatatatgagagtcaggctctgggcgtgtacattttgaaaaactcctcggatggtgctggcttgcactctgttgtgtttatgcaatagtaaaccgatacgtgttttcaaggatcttgctgaagacagatgggaggaagcagagctgaaaggatcagaaagaggaagggacaaggtagaaattacgactcaagtgtggcagggttctgagctcagacttaagctgtacttaccttagaagttcacattgggagatatatctgggcatgcctagatgactggtgggtcagtcatcagagttccctttttataaggtaacatggatcctcctgggaaaaacttcatcttaaattgagagacttttttccccaatatttaattgaaaaatttttaatcatacggaaggttgaaagaatttacccatcatttagatttgataggtgctatcattttgctgtatttgctttatttgctaatttttatagccactgatgatcattacctgaatcaattatttcactgaggagtgggcattggcaaatggtgatttttccgatgtatcatttcttctacaattattatctacattcttctattaaaagagaacttccctttatcaattggagatgaagtaaattttcctaaaaagacatcataaatgcttcattattttaatttggaaagagttttcaggaacctatgtttggtttaaggacagttgacctacattgtagtgaacagatgagctgagtatagcagaggcttgtgcatatttttctacagcccaaccctcagaatgctagagcaaggtagctgcggtgaaaaatagtgtagaaattacagtggctatatcactgaggacagaaagacttggcagcgtgatcagagctcactgcaaactctgccttccgggttcaagcagttctttgcctcagcctcccgagtagctgggattacaggcgcctgccaccacgcctagctaatttttgcatttttagtagagacggagtttcaccatcgtggccaggctggtcttgaactcctgacctcatgatccacctgccttggcctcccaaagtgctgggattacaggtgtgagccactgcgcccagcccaacaaggtcctgtctaggtaaaggaaacgcataggcgaaagtgatggatagaatttgaaaagcagagaaaagatggcaagtggctcagattgaaagagaaattccaaatatactagttaactagttgagggaaccagagagtctctggatatttaatgacaagcttaaataagctaatctctgatggaagtcagcattgcatgaatggttgaagggccaaaaacatgatatatccctttatatgtttaagtgtttttttgtgcttctcaatgccatgtgatgttttttatggtaaatactgagatttaacaaaatataaattaaaagtttattcttgatacaattaatagctcctgaaaagttaaaatgatctagaaatcagaattcttttaatctatactgaatgtaggggttgtggttactaaaaattagtcaaaccatatttgggaattaaagaaataatgattgctggccaggtgtggtggctcacgcctgtaatcccaacactttgggaggccaaggcaggtggatcacttgaagctaggagtttgagaccagcctggccaacctggtgaaatatatatatataaatttgctgggtgtggtggtgcatgcctgcaatcccagctacttgggaggctgaggcatgagaatcacttgaatgtgggagacagaggttaccgtgagcctagatcgcaccactgcactccagcctgggtgacagagcgagactctgtctcaaaaaaaaaaaaaaagattgctttttccctttcacttacccttttttttggaaagataaaacaaagtgactttcttattatctcatgtttcttgtaaacagtgatttcttggtagagaaataaaaattgtttcttaattgggagaaaagaaattaacagctattgctgtggttggttctatttttattatttattggctaaatgtacatagactgaaaggaaaattaaaagacaaactattcactaaatcctggaaaacagtatatgttataatctgcatttcataaaattaagggataattttaaacatatttcctcaaacagtaatataattaagttatgcttagtattcaactaagtgattagaattcagttgtagtggtacttatctttttaaaaaatataaaagttaccatgtttttacagagtggaaatacagtaattaataaaagtgttccattgtgtaggctattttcttccccccgagtgaagctaatcagttagtttcatgctccatatgcagtcgttggatcatttttaaatgatcaatgatcattcttaaatgtgtcaatgaaaagcgccaaactttgtcaaatatttgaagagatttattctgaaacaaataagggtagccatggcctgaggcacagtctcaagaggtcctaagaacatgtgcccaaggtggttaagttacagctttattttataggttttatggagacatacaccatcaattattacatgtgagatatacattagtttgttccggaaaggtgggacaactcaagatggggaggggaaggagggaacttccaggtcataagattttctgattggcaattgattgaaagagttattatctaaagacctagaatcaatagaatggaatgtctaggttaaaataaggggttgtgaagaccaaggttttatcatgcagatgaagcctccaggtagcaggcttcagagctcttatcagacctgaaaaggtgctactctcttagttaattttctctcctggatcaggaaaaagacctggaaaaggaatgggaattctctatagaatgcagattttccccacaagagacagctttgcagggccacttcaaaatatgtcaaagaaatacattttggggtaaaatacttcaatttctttcagggtctgctatccattatgtgatgctatactagaatcaggctggaatttggtgtcctattgctacaaaaagtctgttttgtcagtcttaagatctccgttttagtgttaatgctggtcagctgtacctgaattccaaagcaaggagggtataatgaggcatgtctgacccccacttctcatcatggcctgaactggtttttcaggttaattctggaatgcccttggccgaggggagggtccatcagctgattggggagtttagaattttatttttggtttataatactaattatagtaaatgaatataaaaatttaaataaaatatttaaagctggaatttctaatttgttttgaaaatttaattaaatactggtaaacatcttataaaaataaaactaattatgactctagaattaacacccaaatgtcagtataaaactgggacccccaaactcactatgctaaagagaataacttgcttcatacttattacacctagacatatacacgcatagattcatgagtaagtaatatgagctgggcatggttggctcatacctctgatcccagcactttgaggggccaaggagggagaatcatttgaagccaggagttcaagatcagttctggtgttacaggaaaagggtcctgatccagaacccaagagagggttcttggatcttgcacaagagagaattcagggcaagtccacagagtaaagtgaaagcaagttttacgaaagtaaaggaataaaagaatggctacttccataggcagagcaagagcctgagctgctagttggccatttttatggttaattcctgattatgtgctaaacaaggggtggattattcatgagttatccaggaaaggggggcaattcctgaaactgagggttcttcccccatttatttatttatttatttttatttttatttttgagacagagtctcactctgtcaaccaggctggagtgcagtggcaccatctcagctctctgcaacctctgcctcccaggttcaagcaattctcctgcctcagcctcccgagtagctgggactataggtgtgtgcaatcatgcccggctaatttttgtatttttagtagagacggggtttcaccatattggctaggctagtcttgaactcctgacttcgtgatctgcccacctcagcctcccaaagtgctgggattacaggtgtgagccactgtgcccggccagtccccttttggaccatatagggtaacttcctgatgttgccatggcttttgtaaactgtcatggtgctggtgggagggtctcttagcatgctaatgcatttaattagtgtataatgagcattgaggatgatcagaggtcactcttgttgccatcttggttttggtgggtttggccagcttctgtaccacaacctactttattggcaaggtctttatgacctatatcttgtgccgacctcctgtctgaacctgtgactaagaatgccttaacctcctgggaatgcagcccagtacctctcagccttattttacccagcccctattaaagatggagtcactctggcttaaatgcctctgacactggcaacgtagtgcgatgcagacttaaaaaaaaaggtattagccaggcatggtggctcattcctatagttccagctagtcaggaggctgaggtgggaaaagctcttcagcccaggaatttgaatttgcagtgagatatgattattgccgctacattccagcctggatgacagagcaagaccttgtctctaaaaaaaattaaaaaaaacattttttaagtgtaatatgaattgtttaatattacagactgtttctcagctaccatgaataacagtgctgaatagtatagcaatcagtgattatcactggatattccaagtgaaacctgaagagaagccaaaaaaaaaaaaaaagggacatttgacactctgagacattggtaaagtatctatttcattcatgctctcagagaggaaggatttgtcaaactatttgtattttctcttactaaagtgtttctacttttgtccaaattttctctgttgtccaaagcacagtcttggacagcagaggcacaactcacacacctacatagaatgccagggtagtcaccttttttctttttctttttttttttttttttgagacgctctgttgcccaggctggagtgcagtggtgtgatcttggctcactgcaacctctgccttccgggttcaagtgattctcgcgcctcagcctcctgagtagctgggattacaggcgtgtgcccccacacctggctaatttttgtatttttagtagaggcggggtttcaccatgttggccaggctggtctcaaactcctgacctcaagagatccaactgccttggcctctcaaagtactgggattacagatgtgagccactgtgcccagccagtcaccttttattttgagcaagagctgtggagaaacatttacttggagcctaaatgaagttagtgtcacaaaagggaatgtttaaggttatagattgcactgtggcagctctgagtgctggatggtgagtgacatacaccagtgtgttttttcataagttgatagccctctcttgatgatacatagggccctgtaatgtatggggcctaggcgcccagttctaagattggcattgagtcttagcattaagtatgcacatgttcagatcatgctcctattttccagtagagtaattattcccacagctgtttcttttactttttctttttcctttttattgagacaggatctcattctatcacccgggctggagtgtggtggtgtcatcaaggctcaccgcaccctcaacctcctgggctcaggtgactcttctgcctcagcctcctgagtaactgggaccaccactgcatgctatacctggctaatttctttttaaattatttgtagagacagggtttcattatgttgctcaggctggtatcaaactcctgggctcaagcaagcctctcacctcggactcccaacgtgctaagattacaggtttgagccactgtgtccagccacacggctgtttctatcattctgtattccagagatcaccagttctagtcttctgcaggggtagttgctcaatgtcatgagtaagagaggggaactacagatctacctccttttaagttttgtattaattttttttttaattttgaaataattttagatttataaaagagctgcaaagatggtacagagagttcctgtgtactcttcatcaagcttcacctgttgttaacatctttcataatcatggtgcatttattgaaactaagaaattaacatgagtatgatgctatgaactaaaccatagactttattaggatctcaccagtttttctgctgatgtctttttttctgtttcaggatatcacattgtatttggtcatcatgactccttagtctccaatctgtgccagtttttttggtcttgtctttcatggccttggggatttttgaagaataatggccaggtattttgtaggatgccccttaacttagatttgtctgatattgggatttatcatgattagattgggaatatgggtttgggggaagaatactgcagaggtgaactgccctttccattgcatcatatgaggggtgcatgatatccacgtgactatgagtgctgatgttaaccttgatcacttggttaaggtggtgtctgaaaggtttcctagttactctttttccatactttattctttagaagcaagacactaagtacagcccaaaatcaaggagtggagaatttattttaaaactgcattctaccaatccttatttgatactcccccaccccacttccaaaagtccacttggttcctgagcctttagaagattctgtggtatacatcagcttagtttttggcttttcctactgtatcctaagtcatttttctgttttccagtctccacaattttgttgctattgtctcttttttctctctgtgagtttgtgagtttttttttttaatccctttactgtagcttagtggggcttcggagagattaaaactgtatttttatgttcaatctgccttctttatttggaagctctgggagaaatatttttttttttgagacggagtctcattctgtcacccaggctggtgtgcagtggcgtgatctcagctcactgcaaactccacctcccaggttcaagcaattctcctgtctcagcctcccgagtagctgggactacaggcacatgccaccatacccgggtaatttttgtatttttagtagagacggggcttcaccatattggttaggctggtcccgaactcttgacctcaggtgatccaacccacctcagcctcccaaagtgctggcattacaggcatgagccaccgcgcccggccagagaaacattttatcatcatcaaaattgatatttaatctgtgtttagatttgtcatttctgcttgtcataattctgccattgatataatacatgaaattactgaatactttttgggcaccattgttatgttttgtaaagcattgtgatcaatcagaaattcagttcccagctagagaagaaactcttctagtattggctggtgtgactggccctgattttcaaaggtaaattagggttactgctataaagcagggattacaatggggtgcttctgtatactccaatgcccagttactaaggttaccaaaaaacaaagtgggtttgggcacctcaggagtcaaagtttgagtcagtccaccaggcaaagaaccttaactggcataagctagccaaaggcaacctaaacttgaatgggtagaggaggggagttacaatatccactatggtttcttgaccagttacataaaggaggactgtagctctctgtgtatctgctctctctcctttctttttcaccttttgttttcctacaattttatagagtgttttgatatcagaaatgtttaccatttagtgactgagttgcacttttttattttttatgcgtttttataatttttattactttttcaataaagataatgtatctgttactacatctgtgtaatacatctgtatggcttataaataccattctatactgtactcagaacagcagatactgttctgtactctgctttcctcgctgcatgatatatattagtgcataggaagagtcctttttttcagctctgtagatgtaccaatatttatttaaccaatgccctatagaaaatgtcttgggtttgtttctcatttttggctttacaaacaatactgcagtgaataacttcatatgaacctcattgtataggtttgtaggtatatttgcgtaaacattctcagaagtagtagagttgtagagtatcagtttagtattataatatatctagagtgggattatctatcatctgttttaatatggacaatcaggaaaatagcaatcatttctagtacttacaacagggaaaatttaatgcaggaaagtggttaccaggtgttggaggaactgagcacctaatggagaaaggggagcaattcagatattagtaacaacagaaaaccattgcctgtagcctggaaagacaaaagaagacaagaatcactgaattctggagctggaggtcatttactggaggctagggcctctacggacctgtgtgatgagaactggagctgctgaggagatgcagtcactgccagagaagtgactgagttagaagaggaagggggagaaatgtgctggtttattccttccctcctcatcctccaatctttgagaaaccagctgatatgagtctgggaatcgcagtcaatggatcaaccccttgcgatacaaaacagagcagggaagggcaaggaatgcatttgaggacaaatggattcagaatccatattgttcaccccttctgctactcagcattcaagttcacccttctacccatgtttaataccatcatacttctgtctgtcatacaaacaagaggagagacaccaagtcccatcaatcattgtatccatctcaagtttgggatctactggtgatcctcattccttcccatcaggtctggatgtgtctttttgtggcctggtgacctacgaactaaattgtaaattaagcaaccactgacactttccatgcaaaactgtgggggaaggggaaggggaaggggacaaaatagaaatcgttggttaatagatacataacaaatacacgtgaatgctacaattcttgttgctataaaaagtcgcaaggatgaagttgatttttatcatttcctttttctaccacttattccatatttcctttgcttttagctaggactgcaaatggtttgggttctttacttgcaggatgattgtatcagtcaggataaagccagaacaacagaaaccacacttggtatttcaacagagataatttaacataaggaattggctacggagttttggggaaccaaaaaagcaaaaaaaaaaaaaaaaaaaaccaaaaaaacaggtcggggcagatattgaacatagatatagtaactataggaagaagctaccactcctatggctgaggacacaaaaggaagtttgcaccaaaggaaacttaaaggagaggcatctcagacttctgaggaggggccactgcctaactcttgctggctcattgatgagacatgttgaggctggttctaggaatgccaaaaaaaagttgagtgttagaaatgatagccacttgtcaggaaggaagcatatcctgtctcactccttctgccttgaagaactaacaggaagccaactggcaaagtagaaatatagctctcatagtcccagccccgtggtcataaagaagagtataaatgtgtgagtttggactgagagaaaatggcataacaactgggacagctcattactttgcttactcaatattcatgcacaactttctctgtatatttgagcttctcatatagcaatttaaaaatggcagctttttctttaacaagatacagctaccctttgtagaaattgacactcttggccgggcacagagactcacgcctgtaatcccagaactttgggaggccgaggcaggtggatcgcttgagcccagaagttcaagaccagtctgggcaacatgatgaaaccccatctctactaaaaataaaaaaaatagctgagcatggtggcacatgcctgtaatcccagctactcaggaggctgtggcacgagaatagcttgaacctggggggtggaggttgcagtgagtggagattgtgccattgcactccagcctgggtgacagaacaagactcggtctcaaaaaagtaaataaacataaaaaaataaattgacactctcaccctttccccataaacggatgatcccaaattatattaatctctggattatgtgttaattactcctcaattcagtaaagtcccttatgaaccttctgtaacctaaagatgaaattgtaaagttaacaattgccattaatttttaaaattacagtgggaaaggagaagaaaaaaagttaatatatacagaaatacataaatacacacatatacattaagcaagtaagaaataatgcttagttattagtctttgtatctgtctagtcatgagcctgtggttagtgtcccttcctccccagctcatttcatgcttcctgtactctgagccagtatataccaagtggtgtgatccaaactgtcattcctgaagggtctgaattgtcagtggtcctgtcttttcttggttatcgtagtttaccattaacttttactgtcagcgatgggaatataggggtgccatgttgccatgaatgacagcatccccatatatagtccttcgtggcctcattttgtagcagcaacccaatgtttctttagttgtcaggatcaatcactccagccagtaattcccttctttgcccattggttcagttgcatgtggagtctaaaatggccatttagctgttagaaattcaatggaaactgtcttgggaataaagcagagttcaaattacgggaagcagaattctgtgaagaagtataacagtgagagaagccactttcccttttgctctttgattacggacttgtgtcttgtggctttgggagaaatagtgccatacattggtcaatggctcaaagcatatgttgttctttgaagacagtcccagccttacaaaatgtttctcagctcatgttgtaactgagtctgtagtaggccattccattgttatatcgggccagatatttctagatggtggggtgtgcagtaaggctagttatttccatgatttgcaaactctaattacacttctaagatgtgttccttagaagctgtgttgagtaggataccatgatattgagtaaggaattatgtggtagtgttggcagaaacacaatgggcagaagaggcaaatctatacacagaatagttgtctattctagcacaaacaaatggctttcatttccatgatggaaggggtgctttataatcaacctaccaacacagagttggctgatccccttgggaaatggtgccatattggagactcacagtttagattctgttcttgataatttgggaactcaacagtgccaacagtcagattagcttggtaaggggaagtccattttgttgggtctgtgcttcatttctgccactatggccattttgtacacaagcccattaaaacagaagatgaggaaaggtgctgactgataatcccagaacaagtcactttgttcacccctattattgaggcctcctctacaatggatgtaccttggtaagcactcacacaaattccttcacatttagtgcccattctgaaagatctgtgcatgtgtctcttcttcagtcttccttgttatcaatcttccaggcttgttcttttcaatttcctgaccaggtgaccaaagcattattcactgtccacagatgagtgtacatctgtaccacaggccacccctctttcctggctgaggggacttcaaggtatactgccaaaacttctgccctcttggagggttttccttcaccattccccttcagtggcatctctgagggagtatactggtactagtgtaatgtggacacacttctgtgaaccaggcccaagttggtttaaaaaattttttaaattttttatttaaaagattttaaattgacacataataattgtacgtatttatgaggtacatagttatgttgtgatacatacaatgtatagtgatcagatcagggtaattagcatatccatcacctcaaacatttatcatttctttgtgttgggaacattcaatattctttttctagctatttgaaactataagatattgttaattatagtcatcctatggtggcatagaacactataacttatttctcctatctatttgtttcctttaacaaagctctatctccctcttccccctactcttctcagcctttagtatcctttgttctactttttacttctatgagatcaactttttttagcttccacatgtgagtgagaacatgcagtgtttgacattctgttcctggcttattttgcttaacgtaatgtcctccatttccatccatgttgccccgaattacaggattttattctttattatggctgaatagtactccattgtgtgtgtgtgcatatatatatata

SEQ ID NO: 931 - DNA, 2894 bp, Homo sapiens
ctgagatggttttttttgagacggagtctcgctcggtcgcacagcggcttgatctctgctcactgtaacctccgcctcctgggttcaagcaattctcctgcctcagcctcccaagtagctgggattaccagcacccaccaccacacctggctaatttttatattttcagtagagacggggtttcaccatgttggcaaggatggtctcgaactcctgacctcaaatggtccactcacctcagcctcccaatgtgctgggattacagacacgagccactgcacccagccaaggatatcactttttcttagatctaaggagatcaaataatttatgtttattttaagtttatttctggctacttcaatttttggttgctctgagttccttggacatacatccatatgtgtctgtctctcatactagagacttttctcaaatgtttgaggaccattaaccgtctattcatttgtaagaccaaggcattaaaaatctgagtgtcagccaggcacactgcctcacgcctgtaatgccagcactttgggaggctgaggttggagggattgcttgaacccaggagtctgagaccagcctgggcaacatggcaaaaccctgactctaccgaaacaaacaaacaaaccaccaccaaaaaaaattagctggatgtagtggcacacacctgtagtcctagctactagggaggctgaggtgggaggatcacttgagcccagaggtcaaggctgcagtgagctgtgtttgtgctactgcactccagcctaaaagaatgagatactatctcaaaaacaaaacaaaataaaacaaaaaaaatctgaatgccaattccagtgctggataaaatggaatatgcccactacaagctgctcttcctgacaggttacaattaaaaattggacaacacaaaaagcaattgaggattctgaaaaggaaaaatagctggttgatagaggagagtaaaaactggaagatcaagtagtacactggagtttcttgggttcttttcccctcttctttgcagaattgcccaaggggtaaggtgtgtgaggggtcagacagcaaaacaacaacaacaacaacaacaaaacaaaacccataaaacttctttctggccagaggatgaggacaagagatccatgtgggctggagagcatgatgacagcgtactttcacattcattattttttccctcttggccttgcctaaaggttggccagcagtccaggcacctcaaagcctgtctctttccctggaagaaatgagagaaggggtctctgtggctgtaagcatgtaaaaggaatcctgttgtttcttctcttttctttcactgcctcactcttcgggtgaagccagtcacatggaactgtgtgacagagaaggaggttaaaactgtctgagagaaacccatctttctagcaagagaaacagcgaaaggggtgcctgggagccagagatggggaagaaaatcccagcaaggaaaggaccagagaagggaatcccttaattctgtgtaggaactaacacaagccccagactcacccaagtggcacatgcatggaatagaccccaaaggcacagcaaagtctctcagaaataaactatgatataaaccatcattcaaattgcagacaaatcactgagaggcgcacatgagggcaaactcaaacaggatagcaaacgcttttaaaataaaactggcattgaacccatcacccacagaaggagaggcagagcttgtgaaactggattgcctgttaaaacaaagcaaaatcattattctccagatgttaacaggacccagactcttaaacatactcttcaaaatacactgacgatgcactccaagattatatgacatacaaagaactagaagaatgttaccagttctcaagagaaacaaacgatgatgaacagatgtcaaccctgagatgacacagatgctggaattaccagaatcagatttaaaacagttattacatctatgttccataagtgaaagtaaagagaaatgactgggaagatggaagttctcagcagagaaaaagtaaccattaaaaaaaaaaatggaaactatagaactaaaaaatataagatctgaaattaaaaatccactagatgaggtcaatagcagaatggagataccaaagggaagattcagtgagctgaaagattaacagaaattatccaatttgaacaacagagaggaaaaacatgttaaaaaaaaaagaatagagacttaaagaacaatcttaaatatcaatctgaaatataggacagtatcaaaaggtctaacatttatttcactggacttctggaaggagaaagaaagagattgatgcacaaaaaggtatgaaaaaatagtagctaataacttcccaaatttagccaaatataaaaatttatagattcaaaaactcagttaacatgagagttgattaaactcgaagaatgccacacccagacacatcataaccaaactactaaaaaccaaagacagaaaagcccttgaaagcatccagagaaaaatgacacattatataagtagacaagaattcaaatgcctaccaattttgcatcagaaaccatgaagggggccaggtgcagtggctcatgcctgtaatcccagcactttgggaggctgaggcggatggatcacgaggtcaggagatcgaagatcatcctggccaacatggtgaaaacccgtctctactaaaaatacaaaaattagatgagcgtggttatagaggctgggggagtgggaggaatgaagagatggtggtcaaaggatacaaaaatctcagacaggaggaataagttttattttgagatctattgcacagcatagtgaacatagtaaataatagtgtgttctgcatttcaaa

SEQ ID NO: 932 - DNA, 1856 bp, Homo sapiens
gtttgttgcctcctcttaactgtgagactctaggggacagtgatggagttgctcatccatgtgcccccctctgcctaggagagagtgcccaacatagaacagaccttcaaagaatatcagcttaatgcgtaattcatctattccagttttcatctgggtagattgagatgtccaagattacaaagtttggctatctcctgagggaactcttacacatttcagtagcagagccacccagaggtgtctaactttaagtgcttctctccccattatggtttacagcagcaactttcaaattttttaatctaagaattcttttacacctaaacaccagtcatctccaggacttgacttcatcatttgcctgttcaccattgtatccctagaatctgtaacaacaaccagaaggtactcaataaatatttaatcaatgaacaaatgactaactcatttctactgtaagggtatatgtacttgagagaagttaagtatatgtacttgagagaagaggaatttttattatgtgaaataaggcatatgttaattatcttgattaagccattacacaatgtatacatatttcaaaacatgttgtatatgataaatatatacaattttatgtcaacttaaaaaagaataaagaaataataataacatcaaaaggagcttttatgtatttatttgtatatattcctggggtacaagtgcaattttgctacgtggatatattgcattgtggtgacgtcggggccttcagtgcatcactggaacaacacacactgtacccaccaagtaaccccccatcctccaccctgcctcccaccccctcagcccccaccctctgagtctccactgtccatcattccacatgctacatccatgtgtacacatttttttagctcccacttattagtgaaaacgtgtggtatttgtctttctgtgtctgagttgtttcacttaagctaatggcctccaggttcattcaggttgctgcaaaagacatgatttcattcttttttttaaggctgaataatattccattgtgtatatataccatattttctttatctaatcctctgttgatggacacttaggttgatttcatatctttattattgtgaatagtgctgcaataaatataccagtagagaatgtgtgctttgaagagattgaaaaaggtttgaaataagcacagtagagaatggaatacagagttgactaataaaacatagtggggattgacaggaaatactaggaatccaggtgaagttggtgacaatgaatttacagtaatgtaagtctactcagtagcatgattttccccagcaccactaagcagcctgggtgcaggtgaagacaagatgagcagttgcgcacatctaggtttgagaatttgtcagatagatgtgaataaaagacaacaaagcaagggagtgtagaatactgaccaaaaaatgactcatggaaaaatagaatctaaactgtgctccagcttagagagggaagagagaacatgtgtgcagggatagaactgggaaacagcaggaagatcagtggactagaacagataggagataatagtcaggaatggctcaattcatgatttcttaggtgtagttattttggatatcacagttcatctcagacttccaagagagtttacattcttagtatcccccaaagacctccttcacttagaaggtgaatataatagcaaaaactaaaatttactgagaatttcatatgttcttagcactatgccaagcattttacatgcattgtccccatttaaccctaccagtatcaatagttacttcaaacgttacagcagttgggcccatctatgcaggttgact

SEQ ID NO: 933 - DNA, 6440 bp, Homo sapiens
atttttagattatgatggatcccatagtgctcactgcctaccaggcattcaagtagaacatgtgtatgtggctcattcattcatcaagaacctgtgcactgctttaaatgctgaagagtcagcagtgagcaaatcaggcaggaattccggtcttcatggagcttacattcgtcaggaggtcggggcaaggttggtaggggagacagaaataaataaatagttatacggggcatcagatgatggttatggctgtggagacaagtgaaacggaaggcgcatgggaagtgggaggaggaggtggtaacgattttaaatggagtagtcaggatggactcaccgagaggatcacatttgagaggggtcaaaccgtggaggattcccagtgggggaacagctggagcaaaggtcctgaggcaagagagtgcctggcacgttcccaaaacagcacggaggccaatagggctggagcagtgaacgaggagcttccccaggaacacagacatgccactgagctcaacccattgtatgcgcccatcccaaaacttcagtttggaacaggaagcaggaacctgcagcatccatattttggcgaagggctgatggacagcagtgttggaacttctggagtctactttccactgtccaccatacaagctgagggatctgtccctactggctgtggtttggccattgtctgggctatgtatcctgcaatcctgactcgagcattcctgaagtttctgtaatctgtctgataccacactagccagtgaagattctgtgatctactgctaagagggctgtgtgatgttgaaaatcatttcaggagtataccagcaacaggtgctcaagggtgagcttgagaagtcgagagaatttctaatggcctgcttgcttcttcactgacttctgggttaaaggtggcctatgatgcaagaagttgagatgctggaaatgctcttacattacataaaaggatccaaaaacaggcagcccagaatgttggagtggatttattaggtatgtcatccatccccacctgtgtttgctgagagggcttagaggacacttttgcccatcactgaggaacttgttggtgagaaatgctggcaactttggcctgtcaagggtgtgggtgggagcctttgcctatgaagtggccttcctgctttcagggaggataatgggatcttagggttgacaatggccaaggaatggctcataagcaccaaaggcaaaatgggcatggttactgtaataagcagcagggctggagtgggtggtaatcagatggtttgacctacagagatccttgggagtgactaatggattgtgggtttcctaagaattgaaattggtcattctactaaagttttactgatatgtattctgaatctggatttgccttctctgcctgccacatttctgctaatccctctatccatagacttcacgccttactcattttcatggaaccaaattcaagcctgcttctgatcgaagatctcattttgtagcaggagaagtgaggcaagccttccagttaatggtggcagataaaatacacattttaattttgcttccttttgaaagctcactacaattaaagtagatggtaaagagaaaaaaatatatagcataaactctcaggaacatagtatacaacatactctacagggacataacaataccaccacggattctggaaagcaggtgatgtgtgatgagcagcgtagcagtcctgactctaagtcagcagtgggaagcccagatgcaactcttctatacctcagaatccacagagaaggtccagaattggcaacaccaggtacctttaaacatacaggagaatcaaccaccacctggtagaagccaggtgtttcatttccaaagaaggtaaaccagagggctcttgactaagacactcagcagaggtgaaggcagtggtgcagtgtgaacactgggtaattaaaagaaactccatgttctaaatggaaaaccctattcccactcagctcccagaaagctggcaggtcagctatgacctccaaatagagaattgaaattgagggatctgacagcccaagaggaaacaaaaagatatcagtaagcctggtcaaatcatcctacagtgaagccctctaattaacaaggcccttcacacatgctgagtttccaatgagctctttggcgattgatatggtttggccatgtccccacccaaatttcatcttgaattgtggctcccacgattcccacgtgtcgtgggagggaattgaatcatgggggcgggtctttcccttgctgttctcataatgaataagtctcacaagagctgatggttttataaagaggagttgccctgcacaagttctctctctgcctgctgccatccatgtaagacaggacttggctcctccttgccttctgccatgattgtgagccctccccaaccatgtggaactgtgagtcaattaaacctctttcctttctaaattacccagtctcaggtatgtttttgtcagcagtgtgaaaacggactaatacagtgatctacttttttaaatgtttgaaaagacgacttctggcctggacaaaatggtgtaaacttgtttccccctgctccttcctgtcaagtacaactatgaactgtgaaaacaatgcaagaggcaatcagaagataacactgaaagctggcaagggaattatgcattagtttgggaccctaagaataaaggaacaactcagtggcaggatatcttatgtgcccccactcagtggaagaagatgacccaggcctggtgtttccagacacccagcctatcaacagaaggcagccaaaacaggctcagccctcttacaatttgaagaggagtccctctgacaactccacatgagcccagcaccaccagaggggagattactcaggtgccccactaacaattagcaaccaggggaagcactctcctttcacactgggcccgaaactcacctcccctgccaagagagctgggcagcctgacctgggaacaccccttctgccctctcaggcagcaccagcaggaaccagcaggagctccagcagcaccaaagaaaccaagcatatgaaaagaacaccacaaagcatctgaaaattaaattgtcattggaacctcagcccactggaacctcagtcctcagaccgagatatgcatgataaatgtaaacaaggtgactgatgttgcaaccaatgaactaagtaggacccagagtctcctaacatgatggccaaaatatctaagacacaactgaaactcacctgtcataccaagaatgaggaatatcacaacctgaatgtgaaaagaatcaactggcaccaacactgagattaaccagttgttaggattatctggcaaggattttaaagtggccatcataataatgcttcaacaattgattcaaattttattggaatgaataaaaaaatttaaaatctcaccaaaaaagaagttatatagaagaaccaaatggaaattatagaactgaaaaatacaaccacagaaataaaagcctactagatggcctcaataggggagagatgacagaagataaaatcagtgcttgattgaggacagatcaatagaatttacccagtctaaacaacaaagacataatattgtgggaagaaatgatatatatatatgtgtgtgtgtgtatgtgtgtgtgtgtgtgtgtatacatatatatatacacatagagagagagagtcagtctcaggggcccataggacaataacaaaaaaatcagtgtttgtatcactgcatatcattgcagtctcagaaggagaggagaaagaatgaggctgagagaataactaaagtaataatgcctgaagacttccaaaatttggttaagacacaaaccagcacatccaagaagctgagaaaaccccaaacagaataaacccaaataaatccatgccaagacacatcataattaaacttttgaaaactaaagacaaagaaaaaaatatcaaaagcagacagagagaaacaatacatcacctgtagttaaacaccaattcaaatgacagtggatttatcatccaaaactatggaggccatttgggaggcctacgcgagcagatcacttgagatcaggagttcaagaccagcctggccgacatggtgaaaacccatctctactaaaaatacaaaaattagctgggtgtggtggcacacgctggtagtcccagctactcgggagaccaaggcaggagaattgtttaactcaggaagcagaggttgcagtgagctaagatcatgccactgcactccagcctggactctaacactcgctggacacagtgagactccatctctaaaaaaaagcaaaactatggaggccagaaggaagtggtacaacatatttcaagtgctgggggagctatcagctgtgaattttatatccaatgaaagtatctttcaggaatgaaggggaagtaatcccagaaaatccccataaaatgcttacaggaactaatcaatgagttcagcaaagttggaggatataagattaacacacaaacattaattgcatttctatttactaacaatgaacatgaagaaaatgaaatttaaaacttaataccatgtacagtcactcaaaagaaaatgaaatatttaggcaaaacacatagaggatatgtatgccaaaaactacaaaatgctgattaaagaaataatggaagagctaaacaaatggagagacagagtgtgttcatgtgttgggagacaacatagtaaagatgtcaattctcctcaaactgaattataagtttcattcaatgcctatcaaaattccagcaaagtttttaatagatttagacaagcatattctaaaatttatatggaaagttaaagaccctcgaatagttagaataatcttgacaaagaagaataaagtgggaggaatcactctacctgatatagctacagtaggcaagatcatatggtattggcaaagggataaacatatagatcaatagacccgaacagaggacccagaaatagatccaaataggctcaaccgatttttgacaaagatgcaaaagcaattcaaaacttttcaacaaatagtgctggagcaattagacatccatagcggaaataataacctcaacctaaatctcacaacttacacaaaaattaacttgaaatggatcgtggacttaagatgtaaaacatctaaaatgactttgagccaggtgtggtggctcgtgcctatagtcccagctcctcgggagggtgagacaggaggaggattgcttgagcccaggagttctgggctgtagtgcacagtgctgattgggtgtccacagtaagttcagcatcaatatggtgaccccctggaagtgggagaccaccaagttgcctaaggagaagtgaactaacacaggttgcagatggagcaggccaaaactcccatgctgatcagtagtgggattgcacctgtaaataaccactatactccagcctgggcaacacagcaagactattgtctcaaaaaaaaaaacttgaaaaagaagaaagttaatggtctcccacgtcctgatttcaaaacttactacaaagcgacaataatcaaaacagtgtggcactggcataaaggcagataatagatggtgatagttaattttaggtgtcagtttgactggactaagggatgtccagatacctgatataacattatttccagtgtgtctatgagggtgtctctggaatagatgagcatttcaatcagttgtgcattgttgatgggaatgtaaaacagtataggtgctgtggaaaacagtatggcagttccttaaaaaattaaaaatcggccaggcacagtggctcatgcctgtaatcccagcactttgggaggccaaggcagctggatcacgaggtcaggagatcgaaaccatcctggctaacatggtgaaatcccatctctactaaaaacacaaaaaactagccaggcatggtggcgggcacctgtaattccagctacgggagactgaggcaggagaatggcatgaacccgggaggcggagcctgcagtgagccgagatcacgccactgcactccagcctgggcgacagagcgagactctgtctcaaaaaaaaaaaaaaattaaaaatcaaattaccatgtgatctagcaattccacatttgagtatatacccaaaagaactgaaagcagggccttgaagagatatttatatacccatgttcatagcagcattatttgcaatgcccaaaaggtggaagcaacccaagtgtccactgatgaattaattaataagctaaatgtggtatatatattattcagccttaaagaggacggaaattctgacacacgctacaacatggatgaagtgtgaagacattatgctaaatgaaataaaccagtcaaaa

SEQ ID NO: 934 - DNA, 9683 bp, Homo sapiens
actttgtaaggaaccgctggcagtcggaggtctcactcccgcctccgcgtctccctggccggcccctcctcccacccgccggaaggctcggggtggggggcgctctcggcccacgccgggcagggtggtcccccgcctccccaaaaggtgtgcctggccggggcgcggcggcaagtcgctgcaggcgccgtcaccgccctaggggagggaggacgcgccctcctggcggtggagccggtcccgccaccgagcatgcccagaggctgccgggcgcggcgcagtccgcagtcccggttttcgcggcggcaggctggagcaggaggcaggctgggatggggttggaggggccaagataggcccaaaagaagggggcactgggcgttaggggcgcaggtccagccagttagcaagggcggcgcgctgggaagagtggtgtattttcacgccgacacccgtattttcttggcttgcctcaagccgtctctgcgtgactcgttaccccgccgaagccacccggcatcccaaagcacgagcctggcgcctcctattccacgcggaagtgcccgagtgaccctgtgaaggacctccctcccctcacacacgcacatacacaagcccatgtgggagcccgagtgacgtgtgctcggtggtcatgcaccatcatttcccttccaccttcctcctcgccgcttcctctccctccaccgcgcagctccagccgccttgccgccgccgcatccccttccaagttcaggctgtgggtggaacctgttgctttagctcacgtttcccttcccctccgggctgcacgctgaggatgacctcagcgaggtgtgtgtaaggggaatggagggtaagtgcgagaaaggactcctgcctggcaaggagacaggggaagcgggtaggggcgaatgttctaaagggttgggcgagccaccagagactctttccgccacctccaatcaaggggaccttaaaggaggggaagaggtagatatcaggtgagggtgcccttggcacatccgctgcctttgcttccttagatatttcaggtacctgagtcaaacctatgctggcgttttcaaaaacgtacgggctgcctgagtctggcagctaatctcctttggaagaaggttctattaaatgaaaaataccaacacttggaaaaacatagatgcatcacagagcgcctactaaggatttcctgtgaaccaaccattctgacctgtaagaactgggaaactaggaaatgcccttttctctgtggtgattgtgaaaaatattacttaattttataacaaatcggagagaaccaatttctctgaacttccagatttgggcctgttgctaattgttcccagtgaattctagcctggaccaaatgaattccctggcgtggcacagtccagatggaagaagaggggaatgcatgggattcctaagtagggagtggctgccaccctgaggattcttctaagccctagtgggatgtggtgctgagatcctttttgaagtgatttctgtgaggcacgactctcctgtgctaggtagacctgagccagggaaggtaatctaacctttcaactcctctggaagcagcaatcttaggaataactggaaaaggggccttccggtctggccagctgttttgtaaaacggtactgatgattatttaaattgtcttttatggtaacatctgtaaacagcctgtcttgtgctccaaatacggtttgattttgagattgctgtggagccctgcctgccactccagcggggtggaggtggccctgtgagtaggaagatgtaagtaggaaacatttggtgtgctgggaattagatagctgtttttcagttcaccatatgacatggcatggcttagatcacaaaaagctccctgctctgtggcaggacacaggtagacagataagtactgatcacctggggtgatgagagagagttgtggtttcattccaagttttgaatattaggacctcctcagccacccacccagactccctctgagctctgggctcatccccctgttgcccagatggtccatgttcagggaatgcaaaataaggcctaagaaaaatgtttggcaaagtaagtctagtgccaaaaatgcatggcatttcaaagccaaatataaacatctttgaattacctgtacttttaaattattttccgaccagataatttctggatcagatgggaaagtaccaggtttcccttcttttctcttcatgcaaggtgcctggctagcccagtttcctttctgtttccagccttccatctcctgccaggaaccctcccactttggaacaggaagccctgccaactcctaggcccagcaacagcctgcagatatgtccagcaggatagggagatgatttgcaaagtgattgaaagattctgtcttcctgtttacagggacattttttcaagttaggagcttggagctttcagacttagatttgtctcttgaaacctttgtaaattagacatcagaagtgtgggataagcacctttgtgctctggctccagcacctttccccatcaatcaacaagtcctgtcaattctacgtaagtacaagatccctctcaaatacacactgcccccaccccagtctaggccgctgtgtcctgaaattactaaagtttcccaactgattcctgcccattctcttcatgcagccagagtggccttactaaaatgcaaatctgaacaagtttctcccttgcttcattaactactcccctacccacccaggtctactcactgctcttaaaggaactgtttctcctcctccaccccacttcttttggtaaatttttactcatccttcaagtctcagcttaaatgttacttcctcagggaaggcttgcctgattctctgtacctgcccttactgggtcgggtgacattcgcacgtgcccgtgacactcactgcatttatcttatgcactgtattgaggttgctgtttaattgctaatcttctcactagactcataagaaatacttttatatcaagacataggccaaacattcatataaaaatatatgcaagggaaagaaagtttcataaaactcttattttgtaaaatcatattcgaattcatgtaaaactaaatctggtcacaccttactgcattgacttcccaacccttagatgggtcagggcttctagtgtgaaaaaaatactctaaattccatgaagtgggggacaatttccctcattcacggtaattggaatggaataggagcttaacaggtatttgttgctggaattattaacgataatatctaattcatataatcctcgatcctatgaagaaactactattatccccacttacagatgaggaggctgaagacagtgaggttaagtaacttgccaagtgtcaaaaagctggtaaggtagatggcagagccaggatttgaacctgagtagtttgcattcagaattcttgtcctagtcactcagcttagtatcctttggtcaaggtgcatgtgaatgaatttaccaagcaaaaatgtcagaaagggtctccttgcagctacttcaaactagatctcagtctgccctgcagaggctccttgggcagtatttatgtctgtgcagtgaagaaggcatctggcaagaacagctgttcccctttgctcacatgtactcaacctcctaaaccaccaagtctagcaatatttagcaagtagggagatttaattgtataaaggaagagtatagatacttccaaaaatgcaatttcacattgttatgaactatgtgctgtatatcccccccacccccctgcaaaacaaatcctttaaaaagaaagccaccatgagactggggtatttattttgtcatcagtaggaaactgtctagattaatacttaaagataggggtaagaagatcatgttcctcaggggtcagtgctatttataggattttaatctgtaaaggcaacatttgagaaaggacatgattgaaatatttgaatcaaagagtatgaatagacaggaaaatatttatttgcagaatttccaaactaattcttatattattagccccgatgctgaaccttaagtcgtggcatttagagtaataaagaaatggctggcaaagggtttgtatttcatctttattacatgaattacatgcaggtcacatgcaatacacagatgctctcctatttaatcacctgaatataactacatggagatatttaacagccctgtggggtaaagggtcctggatacagaacatctggggtttgtttctggccctatctctaaccaactttatgaccacagattcctcatgaaggagcccagacacttgatcacagtgtttggcaaatagtaacaattaattaaatgaataaataatgagtgaactaaaaagctacttccagcttgaagactatggatttcattctagaaacaatgagaaatatagtataaaaatgtctccgaatcttttcatcaccttccttgttgggtgatacaaagttggttcctccactaattaaaaatccagatctatctctattagacaggttggccttcttggatgcatggtagctctcttttatttctgtagagccaatgggttaatcttaacttactagtctatacgtgtagatactttggagatggattctatgtacacctaaaattattttcttctcactttcacttacagagctatattttaatgaaaatatgtcctttaaaaaattaacatattaaatgtttttattttctagcaaaccacgagattatatttgttttctacattttcctcaattaaaaaaatgaaatggcaaaatataggcaaaatggcacttaaaagatatatccaacaacctattttccaaacttgaaaccaggacacctggcttgacaaacactacagtgcttacagaaagtaggtgaatgtatgtttgaaatgaagattatcctgaatgatctgtagattggcaaatgaagcaaccctagctgcagcagagggatggtgtctttatcagagaaaagtcacacagagggtgtcagtcaggacctcagcatgtggttgcacagattgtgccctgtatagtgccaggattgtgaactatacaacaggtctcctccaggagggaccatttggcaccattcacatagatggcaatgtgaatggtgccctctggagttgtgcagtgtacaatctgcacaacagtacacagaatctctgcaagaattccattggtaggaaatgtgctctcttgacaggattggaagaggcagcctgctgttctttttaaaataaagtcattcctcagattagatggcaatgacaaaaattcaaccaaaatcttgtttttttctttttccagaaggtttctgccactatattctactttccttaagttgctagcaattctcaaaaatgcaagtctgggccacgtgtggtggctcacgcctgtaatcccagcactttgggaggctgaggcgggcggatcacaaggtcaggagttcgagaccagcctggccaacatagtgaaacaccgcctctactaaaaatacaaaaattagccaggcatggtggcgggcacctataatcccagctacttgggaggctgaggcaggagaattgcttgaacccagcaggtggagtttgcagtgagccaagattgcgccactgcattccagcctgggtgacagagcaagactctgtcttggaaaaaaaaaaatgtaagtctgtaagtaactctgaacttactttttgagcttcattgaagagaataaattgaacaaaagggcatttagaaaaaggtggggaagtttgtagacaactgcaagggtcagggaagcattataagtcataggcatggaagctcatgtatacatgactctaatataagatgaaatgtctccaaaaccgcatgccttctactttaaagtgtttagcttatcaaagaggaacattttcacaagatactctaggaatttaaaactgttttggtcatgtcttgacataattctggaaaccttataacgtcagaaaatagcattgtcagtgccacacagcaggaggcatggaggtagcttggtgggacagaggagaactcttcaggatacttggctctgcctctgactagctctgtgtttatgggcaagaccatccctgcagctagctctctgggccactggcttcctcacgaaagcagagttgtatgaaattgtctgagccttagaaactgccagaatttcatgggctgtaacttaggtgcctccaggggccaggcgggtgaggtaaatgagtgaaggggtcaccaccggtgacagggagttccaggtctgagtcattaaagtcactaaaccacacagcacaaaggcatctgatatggtttagctctgtgtccccacccaagtctcatcttgtagctcccataagtcccatgtgttgtgggagggacctgatgggagatgattgaatcatgggggcagctcttttctgtgctattctggtgatagtgaataggtctcatgagatctgatggttttaaaaatgggagtttctctgcacaaggtctctttttgcctgctggcatccacacaatatgtgacttgcttctcctcaccttccaccatgattgtgaggcctccccagccatatggaactataggtccaataaacctctttcttttgtaaattgcccagtcttgggtatgtctttatcagcagcatgaaaacagactaatacagtaaatttgtaccagtagagtggggtgctactgaaaagataccagaaaatgtggaagggactttggaactagggaacaggcagaggttagaacagtttggagggctcagaagaagacaggaaaatgtggaaaagtttggaacttcctagagacttgttgaatggctttgccaaaaatgctgatagtgatatggacattaagtcaggctgactgaagtggtctcagatggagatgaggaacttgttgggaactggagcaaaggtgactcttgttgttttagcaaaaagactggtggcattttgcccctgccctagagatctgtggaactttgaacttgagagagatgatctagggtatctggcagaagaaatgttaagcaaccaagcattccaaaggtgacttaggtgctgttaaaagcattacgttttaaaagggaaacagaccataaaagtttggaaaatttgtagcctgacaatgcagtagaaaaggaaaaacccattttctgaggagaaattcaagctggctgcagaaatttgcataagtaacaaggagctgaatgttaatccccaagacaatggggaaaatgtctctagggcatgtcataggtcttcatagcagcccctcccgtcatagacctgcaagcctagggggtaaaagtggttttgtgggccgtgggccaggcccagggtccctgtgctttgtgcagcctagagacttggtgccctatgtcccagccgctccagccatgtctgaaaagggccaacatagagctcaggctgtgtcttcagagggtgcaagccccaagccttggcagcttccacgtggtgttgagcctgtgagtgcatagatgtcaagaactggggtttgggaacctccacctagattttgaaagatgtatggaaatgcctggatgcccaggcagaagtttgctgcaagggtggggccctcatggagaatctctgctatggcagtgtggaagggaaatgtggggtcagagcccccaaacagagcccctactgaggtactgtctagtagagctgtgagaagaggaccaccatcttccagaccccagaatggtagatccaccaacagcttgcactgtgcacctggaaaagccacagacactcaacaacagcccgtgaaagcagccgggagggaggctgcatcctgcaaagccacagaagcagagctgcccaggaccatgggaacccacctcttgcatcagtgtgacctggataggagacatagagtcaaaggaaataattttggagctttaagatttgacttccctgctggatttcagacttgaatggggcctgtagaccctttgttttggccaatgtgtcccatttggaatggctgtatttacccaatgcctgtacccccattgtatttaggaaataactaacttgcttttgattttacaggctcataggtggaagggacttgccttatctcagatgagacttggactgtggacttatgagttaatgctgaaatgagttgagactttgggggactgttgggaaggcatgattcgttttcaaatgtgaagatacaagatttgggaggggccaggggcagaatgatattgtttggttctgtgtccccacccaagtctcatcttgtagcttccataattcccatgtgttgtgggaggtacccagtgggaggtgattgaatcatgggggcaggtctttcccatgctgttctcatgatagtgaatgggtctcacaagatctgatggtttcaaaaacaggagtttctctgcacaagctctctttttgcctgctgccatccatataagatgtgacttgctcctccttccctgctgccatgattgcgaggtatccccagccatgtggaactgtaagtccaataaacctctttctttctttctttttttttgagagggagtcttgctctgttgcccaggctggagtccagtggcgtgatgttggctcactgcaagctccgcctcccaggttcttgccattctcctgcctcagcctcccgagtagctgggactacaggtgcctgccgccacgcctggctaattttttgtatttttagtagagacggggtttcactgtgttagccaggatggtctcgatctcctgaccttgtgatccacccactcaggcctcccaaagtgctgggattacaggcgtgagccaccgcacccggccagcctctttcttttgtaaattgcgcatctccggtatgtctttgtcagcagtgtgaaaacggactaatacagcatccaaattaaaaatcggaatgaaaagcaggtttcatcctcaattcatccctagatcaccacttggaccccagctcttagctccagatttccagagttccaagtctacatgaacatgaaagagtcagggagactgtacatcttggcttgggcaggatggtcctgctttatacttgttgtcctggcataattattaatggcaccctccttcactctcaaaagtgtcctagtttacatgagaagtcttagagccatccaaagtcagggggaatcagtgactaaacacaaacttttaggagcaagttcatttattcaagtttgtgcaagccttcagatgaagctaagtagatttggcattgttttgtaagtataaagatatttaaataaacttccaaaatatcccaacagaacggttcaataaaagcagtatgtcatgaattttaaaatcatagacaatataggaaaggctatcaatatgtgaaaaattttgaaattcactaataatcaagaaaaatttcaataacaatgaggtaacattttgcctaccagagtatttaaaaattatttaaaactctaataccaggtgtcaggataggtgtgatcaaaggaactctcatataccgctgataggtttataaattgactgatacaaactttctggaatgatatttga

SEQ ID NO: 935 - DNA, 22832 bp, Homo sapiens
agcagcgcgagaccctcgccaggctctgaagacgcggcctggccctggccgttcggcccttcgtctgagcgcaaaggctccagcacctccgcggccgaagccgcgggacttttcgtggaaaatgggacccagcccgatcgccagcggcgctgcagcggactctgcgggaacctagcttctgctccaggacctccagggccaccccagctcgcagggcgttcgcagcggctcagggcgaatcacgctcatggtccccgtgcgcattttcagccccagccggtacctccttactcgccctcacgacattcattccaccccctaaaggtcctgccaaccccaggctcttcccgagcattcccgcccttcctcccttttgaaaccggagcaaatcacggccgggcggaagcgggggagcccgggtgagagtcagtgactcagctgcggactccaagtgtcgccggaggccctggggcgcaggcccagcgggctgtcgcacagctcggctgtcctgtgccccttcctgacgaggctggggaggaaaggcggcccagagaaggccggaccagctctccccgtcagccccaggctctcgaatgacagcggatgccagcgaccggggatggggtcccggaattgctgggttaaacaagctccggattcaggcctgggcctgggctggggttccagggttctggaccgccctcaaagaaggagctccctggggcggcacctggctctgcttgatagccccagggacagggagctcactacctatcagggcagctcccccagtgccgagaccagctcggtcctggagaccctaacccagcggtgctagaggaattaaagatacacacagaaatatagaggtgtggagtgggaaatcaggcgtctcacagccttcagagctgagagcctccaacagagatttacccacgtgtttattcacagcaagccagtgataagcacagtttctacagattatagattaaaagtaccccttagggaaacaaagggatgggccaaaataaaggggtgggtttggctagttatctgcagcaggggcatgtccttaagtcacagatggctcatgctattgtttgtggtttaagaacgcctttaagcggttttctgccctgggtgggccaggtgttccttgcccttattccggtaaacccacaacctcccagcgtgggcatcatggccatcatgaacatgttacagtgctgcagagattttgtttatggccagattttgggggcctattcccaacaccctagcattgctcacacttgtccctgaagtgtcaccttgtcgtagctgggctctgagccctctgccccagggaggggtggccttttgggctgaagggactgaggacatagccgttgagcctgttggccattgctcaaagaatgcagcctcctggtcacccatgttgtccccttgccaacaaaaagagtgaaacactgtgcaatgtttgaagagatttattctgagccaaatctaagtgactgtggcctgtcacacggcctcagaagatcctgagaacttgtacccagagtggtcagcctgcaactgggttttacaaattttagggagacataagacatcaatgaatacttgcaggatggacattggtttggtccagaaaggtggggacaactggaagtgacagagggacttctaggtcataggcagattcaaagattttctgattggcaattgattgaaagagttaagttgaccgggcatggtgggccatttctataatccttgccatggggaggctgaggaccatttgagcccaggagttagataccagcttgggcaacatagagagacctcacttctccaaaaaaaaaaaaaaaaaaaaagttattttttaaagacttagcattaatagaaaggaatgtctggttaagataaggggtcgtggagaccagtgtttcatgatcagatgaagcctccaggtagcaggcttcagagagaatagattgtaaatgtttctcatcagacttaaagagtctgttctctcagtctttaaggggtgtgttgatgttactgctggtcagctgggcctgaaatccaaagggaggagggtacagtgaggcatatccaacacccatttcctgtcgtggtctgaactagtgtttcaggttaaccctggactgcccttggtcaagagcaggggtgcattcagatggtgggggtgcttagaatttcatttttggtttacaccactgtgtcctctcctgccaggggagggacccagagctggaggcttagccctggagataccggtgaagatggatgaatgagaaaccagttggagcttccaaggtctctacccaccctccagacctcctctgctcctgcccctgcccattcattcccaacttctgctctcccagctcccctcccacccacatgctgttccctcctcttccatcttccgcttcctgggcccagagactgggcaagatccccagggctctccttgcacagcgaacctctcccagggtgcatagccttgctgcaatcttacacagggaatacataagcaaggaatacttctgtccctcttggactctgaagccagaaggccagggcctggttggcctcctaactgctgtgtcccagggccagagcagtgccagacacccagcagtcttagcacccacgaaagctggagggacccacaccttccccatcactcagttgcatcagtctaacgcaatggatttgggcagcttgtggtggttcactggcagtttattgggggacttgaaggagtcaaggtcaagtgggggacttctgggtgccagacctggcccttccttggcctgggcttggggtgtccaagcccacagagccatgcagggggaaagagctaggcaagcagggtggttgaggaggtcattagcgtggcctcgagggaaaacaattccaagaggagcccaaattcgaatgtcccctggtgtcattgagaatggagagatttaggttatgaattgtgcagttggtgggtagcaagccagggtcctgaagatagtctgcatatcccctggtgtcattgagaatggagaggttcaggttatgaattgtgcagttgggggtatcaagccagggtcctgaagatagtctgcatatcccctggtatatatcatttatataaggatgttacttaactattgctgtcttccagaggcagcttcttgaacaaatacttgaggtcctctataggtttacgggagtagactgttttctccaagcaggcctgtcgtccatcaggagaagcaaaaggttttattctagagacaagtccttccaactgtacagctgatggagtagccaaggaaacctggtctttccagagacacatagaaggtgccatctatgaggaacaggccttcaccagacatcaaatctgttggcatcttgatctttgacttctccaccgccagaactagatcaagacatgaaacccatgttcaagatactttccagtgtgtcttcatgtgatcctctgagtccagccatcaggctaccagcagctcttggaaaccctgacatacttattcttagaagactgctttccggactcaaagtggaacctcaaattttcaattttctttgtttttaaagcctacacataggtgatgatatatacatgcatatatattttggagaatttataattctgaaaacaatgctggtcttatggaacccatccattcccctttccccgtgtgtgctccgagctgtggtggcacgtgaaaaggggtccttccagcagtggcccacagccctgggctgcttacttgctcacttcatttacaagagcaagaaatacacattcttgtgttgtttaagtcattatgatgtggggatttccattactcacacacctgatctagtagtaacacagtagcctattttagcaatatcatttattcaataatccattctttccccattagttttgagccttcatttattgtgtactaagttctggttatttttagtggttgtaatctccttctttcctactctcttaatcatgggattgccaatatctgctctgtgtttctgtgccatctatagcctctggccttggtactgcttcaaaactgatatttctaaccttactttgacttctccattcagtgaagttcccatagttcatcactcaactgctctctttccatcgtgaccttctgaactagctcacacccagatgtacttttgttatctgcctttccccctcataaacatgggctgctgctggggaaaatccactaccgaactcttgcaggtctctgcaaatgtttaatgccctgtcttagccatgacctccacaatgctgggctatcctatgttatgtcccctaagatatcccttctctcttacctttggggatagtcctaagcttccatcatggcactcaaagtccaaccttatttgtaccctcattctctgagcagacaccaccgtattctgtttcacagagaaaatgtgactgctggggataattctttcaacttcctggcctcttcctatacatgatctttctctgtattcttgcctattgctcttccatgttgatagaagtgtctgttctccttgtcagtgtctcggccttggatctgtcccctagactattctgcctgtgtaaggaccttccctgaccagctgggccaccatctcctgcttctccaatccctcactctagactgactcttaacctttggtcaacaatacttgagcttttacattcataatggagcatctgtgttgaaccttgttcttttctagacactaccctccgttctgtcttccatccatggtgacttttctagaaagagcatctatcacactggagacagcaaactccttgatccattctaattcctaaccctgcaataattttctatctcccttactcaagtaattgggagtgctcctagtgttaccagagacccagcagttcccaatttcgaatttttccgtattcacatttcttgacttgctatgattttacatcacagattacatccttcatttgaagagactctaatggaaggctgccatggaaactctctcatgtggctgacctcctacctcacttgctctttctgaatgaagttcccacttttgcctgccttaatgaaagtaatgctccccaaactcaagcccagggctgcgaattggaagcagctggggctactgtttctgggtgctggtgtgaatggcaggatgtgaacaccagcctgtgacgggcaaaaagatggacacacaggcagagcctgacaggtgctggtggtcctatctggtcctgagttgctgggaccctccttgcccactgcccctagaatggactttggcctcaggttcgaagtgttcagatgtgactgagatgagccttttccccatgcctcaggaatagcgaagaaactctatctggaaggttccccaggcttccccacccagcagcctctggtattagaccaggcagtggctggccaggatggtggggacagaagggagacaaaggtgagcagtgggtggggtcacatcctccctgacattgaatagacaacatggggaggaaggatgagtgatctttagaatgttcatggaaaatgcatattgggaaaaagaatgcatgaatttcaaattgttttgcaacaaaataaacttgtactaacttgtgaaaacacgtccgaacaggatctagtttgaggccctaagaagtataagacaacagtttgaacagagctcctatcagacacatgaattctgctaaaattgaaaccagaacaaacatgcaattgatggtgaagcttggctggaaacatggtgaaatcattgatgatttattgaaagtttatagggacaatgcctcaaagaaatcagcaatttaagtaagtggataactcattggaagaagagaagagatgatgttggagaggaagtccacagcagcaggccagccacatcagtctgtgaggaaacaattcatcttgtttgtgccctaatttaagaggactgattaatagcagcagaaacaatagccaacgctgtaggtatcccaaggtgttcagcttacacaattctgactgaaattaaagttgagtaaactgtccactcggtgggtgccaaaactttctcccagctcagctgcagataagagaaaagcgttctatggccattttaaacaagtggaatcaagatcctgaagcatttcttcatataattatagccggagatgaaatgtggcttaaccagtacactcctgaaggcaaagcacaagcaaagcaatgactacctagaggtgggcgtggtcccatcagagtaaaagcagacatgtcaagggcaaaggtcgtggcaaccgttttgtgaatgctcaaggcatcttgcttattgactttctggagggccaaagaacagtaacatcttattatgagagtgtatagagaaagtcagccaacgatttagcaggaaaacacccaggaaatcgtcaccccggaaagcttcaccagagagcccttctccaccatgacaatgctcctgctcattcctctcatcaaacaaggccagttttgtgagagtttcaatgggaaatcactaggcatacaccttccaggcctgatttggttacttctgttttataattttaaaaaatctttaaagggcacccacttttcttcagttaataacgtcacaaagactgaagtggcatggttaaattcccagggtgcccaattctttagggatgaactgaatggctggtaccattacttgcagaagcgtctcgaccttgatggagctcatgctgagaaataaaacattttttaatttttatcttttaattcaattttttcgtgaacttttgaagtccccttgtatttgtttttggtggaactttgagtctgatttctcagctccccatggatggctgcatcttaacagagaaatgaacgccatttaccctgatgctctctacttggcctaagtttcagatgttgaacacacacgtgtgggaatttatgaatctgtgcacctgtgccagctggtgggtgaagtctaagtttcttcaacacaattagttatcttctgcctcctggaatctggtaggaaaggttgaggaaaagcagccatccacagcgcctccaccactggaatgggggcagccctaacgtgtgccccactgccccccatgctgaggagtccttcactccagggatgtcttcaccccaatcattcagactcccccagtgttcctgcgtcacctgaaaggtcggaagcatctcagcacatactctccatgagtggtacttaggcctccctccccatcaatactgaagccctcagaggcagaggggagtcaaggaaaagagtggccatcagcaataaatgagttacaaggtttgatttcaaagagaaaaacttgtcaccaaaatcactactcaggagatctggacttcctctgaatgtgagttaaagaacccttgagggttaagagccaactgcacctgatccccactctcccatcccaagaccctgggaagtcaaaccaagaggtaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatatttctaataggaaataaagaccgagagaaggcaatcacgcaattccaatgcctgacaccgaggcccttctgtctgggtcaaagcctcacccctggcggccctgctcaaaggtgcacagtcaactggggcaccaagggggagtcgggaggacgagggccaggcctgtgtgttgaatgctgcttcagggaagggctggcttctgcgtggtatggcctgtccatatgcactgggaatgcgggtctaggggttgctgtttgggaacaaacaggtctcaacttctcaaacacagggttggctcaggcctttgtgaccacagacagacacatgactcccagccattctggccatcacccagggtgtggagctggcctcttggtgggcctggctcgactctgagctgggggtcttgtctcatgaccacacttcatcttatacatcactgtacaaatcattttgccatattaagttataaagtcgatgtgggccacactgagtctgaagcatcacctcagcaccccaccaacttcgtggataccgaagggctggagagtgactgctgggcggaatcagaattcacgagccctgaagatctccctgtgggcagaatgtgctgggtgtccagattccccttggggagggcttcatgtacccagaggttttcaggggaatcacagatgacagagcagtggtctccacaatttttaaggcatgcaccctcctttgagaacacacttgaaggctgtacaccttggttttgtgcatctcttgtaagagtgacatagacactgttctctgtggcgcatttaacactattaaagcttaatttttcatttaaaaatggatgatatgaaatccagattttcttcctacctcccagtatttcatctggacccactgtagcaggcactgccttacactagcacagttcctacacctctctctggcctctgaggactttgctcttcacattttaaagggaaaaaaaggcagggcgcggtggcttacgcttgtaatcccagcactttggggggccgagggcgggtgggtcacctgaggtcaggagttcgagaccagcctgaccaacatggtgaaaccccacctctactaaaaataaaaaattagccagtgtggtggcgcgcatccataataccagctactctggaggctgaggcaggagaatcgcttgaacccggaaggcgaggttgcagtgagccgagatcacaccactgcactccagcctgactccgtctcagaaaataaaaaaaaaaaaaggctactttctattagttattccccattgaggaaaactagacagccctgattcctgaaagccctctgttcacctgcctttgggtccccaacaagagcgaagatactcactcacggccgctataacgcagtatggctctgtccatttgcacctccttgggttctggcactcgaaagtgttttctctctcacaaacatgacaccacactctattgtcaccctcgtctgaaaggaggaataaaaaagaaagcagaatgttccagttctccgtgcctatctgatgaacacagccggcatccgaccagcacaaactcggcgggtccccatccttctccccctgagcagtggctggggccacatgactcgagtgagccgcatggggagaaagcaggaggggtctccggccacgtaagagctgcccgcttccccttcgccttcccccatgattgtaagtgccctgaggcctccccagaagccagcaccacgcttcctggacagcctgtggaactgtgagccaattccacctctcttctttataaattgcccagcccccggacttctttacattctgagtgatttttcttctctcctgggggctcccccgtcctcccacatccaagcacacaacatgagcgcacagcgcacccccactcggccgcagcaccctgaccccaggtcggccacgcggcacccacgggccctggcatctcccggccgacggctgtggaagtgaccctggggcttgggtctgctcccacgtgccctcccgcccacctcccaggtccacccacctcccaggtcctgccccccgactccctcaaaggagttctcccttgggtctgggttgggcctggcctagctctgcaggaggagccggccctcctcccgcagcttgaacggttctcagcccgtgaagcccccggaggccaggccggcgggagcctgcagcctgagggctcccggggaagcgcggccggagcggggcaagggctggggaagggccgggctcaggctgccccgccgccctggtggaagccgcacgaggcgaggctccccagaggcttccaggcgccacgggccgcctgaacgctccgttctcacggcctggtcggggcggtggccacgcggtgccaggcagacgccgcccggccctgtcctctcggcccgtggctgtggagggcgagccaggctcacccgttcgctgggagtcctctggatctcgttgtctcgcagtcaggttggcgtctgtccacacccgcggtagggccacgaccagcagcaaggcgagcagcgccatcgtccccagcggtgcccagggagggtcagcgcgcggcgccccctccccgcccttctggaaccttcgcagcctccgcgcgcctctccccgggtctggccggtagggggagccccgcccgccccggggcgcgcgcctcccacccgccggggcctgtcggggtctttggagcctcatctcagggcctcgcggccgctggcggccctgaacgccggttctgagtcccgccttgtgctgctgttggagcggccggcggccaggcaggaacgggcgcgggagccctgggaaaggcgcgtgtggaaacgcagcccctgagcccaagggccgtctccttgaggaccccacggcccacagaaagtggccggcggccaggtaggggatcttctccgctgaagagcacgggctcacctctgataactcgcccctgaatagcttttagctcattataataccaaaaaaaaaaaaaaaaacaaaaaccacatccctggggagagattccagatgctaatgacacactccagcgcactagtgtgtgaggtcacggtgcctgcgtgccctgaggacttcccaaaacgtgcttactagtaaggcccctgcctgggccgttcgtgagtaatcctgtaaaactctcatcaagagggtctccccagcgtgagtagcgactgactcattcttttgagcagttcctctttcaagctgtactgttttccttaactaaaagctcaaataagaattcctcctggcgcctgtagtcccagctactcgggaggctgaggcaggagaatggcgtgaacccgggaggtggagcttgcagtgagccgagatcgcgccactgcactccagcctgggccacagagcgagactctgtctcaaaaaaataaaaaaaaaaagagaaagaaaagaattcctcctaagtcactagcttttggctctatctcctgagtggcaggttctgtcttgtctctctgagatcctgactctttaaataaaggttacttaaccctatacctcttgctaggcatctcttgtctgaattccttcctccaagaagactaagaactggaggatttccatgcctctcacagtgacagtgctacccaaacatcagggttgtcatctaggccccctgccctgcacagaaagccaatcaccaacagcagtgccagggaagaaggcctcattcaagtgctacagcccagagatgggcgctcagtcacaaatccctctcctcagcccactaaaattagaagtttccagagcagggaagaaatgtcaccctgtgtgggaaaacaggaattagggagagtgaggaggcagctaggcagtcatgactggtgaggggtctggcctcaaggacctactgagtttcagcgccttgatactgtctgggaggcccgatggttggtttcctgagaaaggagctcagataagacaaatgtaactttcccaagttttaagacagggtgggccaatttctatgtttattcaaaagaaaccctaaatactagttttacgagaaattgggcccatgtgagtaggccccaaagggcaatccacaggtggtgttctccaccctgctttctcctctcaaccctctgtatagaggccctctgttaacacaggcaggagcaggaatttcacactcttttcctttctttgctttcttctttgtcttttttttttttttacagttgtgatatagtttggatctgtgtccccacccaaatctcatgttgaattgtaatccccagtgttgggggtggggcctggtgggaggtgattggatcataggggtggtccttcatgaatggtttagcactatccctttggtgctgttcttgtgatggagttctcacgagatctgttttttttaaaagtgtgtaggcaactccctttcttcctcctgctcaggccacgtaagaggtgcccgcttcccctttgccttccatcatgattgtaagtttcctgaggcctccccagaagccagcaccatgcttcctgcacagcctgtggaactgtgagacaattaaacctcttctctttataaattgcccagcctcaggtatttctttatagcaatgggagaaaggactaatacaagttgcatcatattccatggcctggatgtaccatagttaatttaaatagcctccttgaatgaacatttgtgttgttcacagtgtttttatatctcacatgtcaaagtcaaatacattataggatgaatctctaaacgttttattcaggaatcacagaattgtaattctgggcgtacacagaccagaaatgtgtttggtgtgtctgacgaacaaagagaaggttgaaagttttatttaagaaatgttacctattgtttagaaagaaaacttgtgggccctggtagaggtttggggagctggcaggctctgatgggtgagtgacacagtaggtagaccttgtctttgagtcacggcaggtcgttccagcagctgttaggtgcacctgattgtaaagttgcagcaggcgtttcagcacttgggcttgcagatggttcttggagcaggtgctgtctgcctgagtggttttcctctggccctctgccttgacttagtcgggtatgaccagaataactcaatttatgaagtcaactttcatatacatgacgctgcaattgtccctaatgtcattccttacatataccattataccacagctttccagaaatgagatcaagggacaaaagttaaatatatttgcagtttatatgagtattgcccagttgctctatctggtctttggacaattttgtcattgaggagtgagtgcttgttttcatggtggtgtcagaaagaatgtcctcttatttactctttggattttcaccaatgtgacagatgaaaatgaaaatagtatccgggtgtatttttaatttgcatttttaaattataagtgagcttgagcacttgatatggtttgatatgtttgatatggctagtggatatttgcattttcctgtgatctctctatttatgtctctcgtccattttcccgtttaacagacattgcttaacagaagacaatatttgagttgctgaccaatcccgaaatagttgtgaggtatgatatcagcaggacttgttttccgagccttgatcatgaccctgtgatcaaaacaggatataacaaagaaactggcccaaaccagctaggaccaagatggtgacataagtgacttctagttgccctcattgctcattatatgctaattataatacattctcataagacaccacatcagcaccatgacaatttacaaatgccatggcaatgacccagaagttatatggttcatatatgatgccaaaaaggctcattacaatggatcttgggagtaatttttcaaggaatatgaacaaagtcttccctctgtggttaattcatgaatgctgtgttggaatattctggatggtccagactttcctctgtaatcgacgttgagccctgcacaacttcaggagggcgccagacctcactactctcaaggaaaaggctgaagtggaggaattgattcccactgatttttttttttaatttttttgagacagagtcttgttctttcaccaaagctggagtgcagtggcatgatctcggctcactgcaacctctgcctcccaggtccaagtggttctcctgcctcagcttcccgagtagctgggattacaggcatgagccaccatgcctggctaattttagtatttttagtagagacagggtttaccatgttgaccagtctggtctcgaactcctgacctcaaatgatccgtctgcctcagcctcccaaagtatagggattacaggcgtgagccactccacctgaccttgattttatttttaaccatcctgtctgagagattatttgtggaggctgacagcagatgtgcagggttcaacagtgcagtatgctgcatttcttcagctatacctcatattgtaaagactgtccaggtaactcaacaagcgggaggtaagggttgcaggtgggatactgtagtacaccccattggtctaaaggcacatttccttcttttccacccactgttgcagtccagccaggcataactttaggagaatgtggttaggtaaacatgtgccatttggcacagggatatttgaatttcctggcatgaggagtggcgggacttggactagctaaccatgagagtgagttagtagagatgtggatgccgtcatgctgatggcctgctcagagtagcactgggctgtattcgcccaaacacccaacagagcctggccaaatgcaaggcccagtccggtctggggacttctctggaatgcctgtgccagtataaccgggaatgtccctcaaacagagagaagcaaattattatctcttactgagccctttgctaaacaagaagcagagccatgtggacctatgagagatctggagacacaacattccccattgaggaatacaccgcccttgctattctgaattcaaatgggtccctgaaccaataaaagcatgaatgtattttcaagaggtggtgcatgcagcttcatgcaggcctcctgagccagtcgtccagatgtggttaggaatgtctgctatcaggacacttgctgcctgggaacccttggcagaggccagcactgccacccagcagggacctctggtgtgttgcagctgctcctcaaatgcctctggaagacaatagcaacttacgacttccttaccaggaaacagcatcagatagccttcaaaccagaaatgcctctcatgtcttgatgtcagagaaccattctaccaagaggaggagcagcccagcaaagtccatcaaacggtgagagtatattccagagcagggggcaggaggacgttaggggagcctgtggcttctgcagcagaggcaatagcagaaggagaggagagggaggagcagaaggagagcagagggagagcagagggaggagccttcaagggctgctgtgtgttcggagcccagctaaagccaagcaggcctctgagctccctgctaggagttcatgtctgcagggcatgtggctgcttggaaattagccatgtagacctcacagtctgtctttgccagagaaaggcagggcaaaccatattatacacctttataacattgtttcaaatccagaagtgtgatgcctccaccgttgtttttctttttcaaaattgccttggctattttttttttttttttttgtggttccatgccgattttggattttttttcttttctctcttttttgatggggagggatggagtctcactttgttgcccaggctgcagtgcagtggcacaatcttggcttactgcaacctctgcttcccgggttcaagggattctaccacctcagcctcctgagtagcttgagactacaggcgtgtgctaccatgcccggctaacttttgtgtatttagtagagttgggattttgccatgttggccaggctggtcttgaactcttcacctcaggtgatccacccacctcggcatcccaaattgttgggattacaggcgtaagcaaacgtgtccagccagatctttcttctatttctgtgagaaataccactgaaattttgatagggatcccattgaatttgtacattgcttttgatgggattactagagaaacaggagtgtaggagagccagagtgacgccattttaaagccaattccattttaaaacaagcaaggcaattccttgccagtcacagcccatggtcacaggtgttgacagctaaggagggagtttagtaatgcctgcaaggactaactcctacagcaacaaaatgtccaaatgcgccaatatctaataacaatatgtgcttttaaaataattagaatcatgctttgatgtacttactcactaaaatcccaaggatagtttactttaaatcaacaaagtaataagttttgtcacgctgtcaacccacccacacatagacttaacttagcttttacatagataagacccctacatgagaggagtttaaaacaaagacaatgcgttcctcctcttgttttctgaggatgccctactctgcatctgagtagctttcaataaatgatctcttctcactgcactctgtgactcacctgaattccttcctgtgcaagactgaaaaaccctcttccagcaacatctttctggcgatgcactaagggaccataagatgagactatgtgctggggaagttttgtctgcagcaccagttggccacctctggtaaatggggtccttcttggcatcctatgtcatgcttagacaaggatgctcgcctagaaactcaggttagaggctcagcccacaaggttagatgccctggggtatatctggaacaatggaagtctctttgcaagatgtttgtcagtacatgatctgaactaatccaccttgtgccctctgctggggatgggaaagctctacttctcatcatttcccagctcattgctttgctgtactgcagccttggggcagccccaaatggctggtccagaggtttccaccttccagtggcggattctaatgttctttatgtgtttctctctgttcttttctgcctgctttggatctgctgttactaatctgctgccgagtggcaactctgcttatctcacggtgttgaggtgagactcactgtttttggtattactaattcaaggctacctggagattgtcttttcttgtacagttcagccagttctggctaaaatgtatacattaaaaactcatttaaaactgaagaaaaaaatgatgaaaaggttttttttttttttaaaccaaacttccttaaagactactttaccaaaactttggtccacagctttccttggattgcgtgttggatgtctgggtcatttccaattaagaaaagtttatgctatgggaaacatgtttctagaattgtggaagggtcttatctataaagtgctaacatctggcaaacagtgcaggatctcttgcttcctcagttttcccactcacggatgagcgagtgcgcttagctgtcccttcccttcccttcccgctctggtttcctgtatgcaatgtgctcagccttccaagccttgggacacacagggatgctcatgctcctttatgttcccctagggactaggggttagtggacctcacccagaggtgtgggatcctttgggttctgtctgctggggagcctggagccggggatcctccaggtcagccaccatcctgttacatggggctcttcagcctttcgggtcccagggctgcagtgccaccccagtggaaagcccatttgagactcagagggatatttgccagcatgtcctgctgggtctccctcgtccccttcattggctgcatatttgctgtctgtgcctcactagtgatgcccgtcatcctgagcttgcatgctctgaagtttatgcctgccattttccttctcctggtgattttctttctttgggttatttaattcagcatgtctctgggcagcattggaggccaaaagcctcccaggaactagtcttattgagaagaaaaataattttgtctaattcagaagttatctaaaggtcaattcaaatgatgaacttgaaaatagttacttatgaagcaaggtagaaaggagccagtaagtaggggagcgagagatgtgaataaaagttatggatatgaagatgtatttttggtaaggaaggttataaagaatagcaaataatgtatgaaaaaggatctcgtgtggtaaatttttgtcctaaagtaaaatgactaatgattattagtcattagccattaatatgactattattattagttattagtcattaatgactaaatgattatttaggaaagagagaaggttagggcaaggcagaaagtccaagcacatctaagatggtctgtgtacactgggataaagttcgtgaaggggaatttatgaaaggaattttgtatatgattaagttggttataattgaaaggaagccatttataacagtctttctaaaaattggtcgcctacgttaaaacaaagttttcttgaggtactgatttgctgtgaatgaagttacaagaaattttactttcaattttataccccgtttctcttctaaacttctcagatccatatttccgacattccattttttctgtctcactgctttcagctttttcccccttgagcaggcctgagatgatgaccttctccttcagcattttttgtcagctcctgcaccccttttttcctccagttttaactgttggaatgacctgatgctaaagttttatcttgaaggtctagaaaagcaatgttttcttctagtataacttgattttatattcttggcttttcttgctgtgtctaaattttcagtgtaatcagaaaacttctcatgctgttcctaagggtcacatatgctcataaccttaaacactgttcctgtgtctgattgcattcaagcacttctttcctcaagtttgtcttccaggttatctaaatgggcttcctgtaagaagaagcggtctcactgcagaaggttttccctgcctttttattagctggcttaaaaaaaaacaagattttatgtttttttcacgataattcctatactgtctttattagctttatgattgcaaaaaaactgaaagttaaaagggttaaggtttttacctccatgtgactttctctattgcttgttaaagtctttatgattattactcttggttaagtgtataactattacaatgacctgtgattttatgttaataaaatgttttgagccttttaacatcttagagaaatatcctcaaaatcaaaatcttaaatttagtctctgatttagtcttattgctggggcttattaagcctatagaaattaatctctgcaaggtcatagactctttctagaactttctggcagaccatgaagtccagtatcaccacctccagcctgaaaattatatattggaagaaaaatcagttaaaggattccctcagcccccttgaagctgtccttatcaagagttattaaccaatgcttgtgcttagttaataacctgttgtagggctttgactcctggacacacatatctaaagatggcactgacttctaccagtatctgacaaaaactcaagttaactgaaggctcgtctttagacctgggcaaaggggacaacgtaaactgctttcatgagacacaaggacaggtctgtattccaaaacattatgattcatttcataattttgcctttatctgaaataatataatttgttctatgtctatgtggaaggaaaatatcttgggcccccagaatcactaaggtagagggaaaattcaagctgggaactgctcagggcaaacctgcctcatagtcatccctctgcttgtattcatagtcatccctctgctcactgagataaatgcatatctgattacctgctttggaaaggctaatcagaaactcaaaagaatgcactgtttgtctctcacctgcctgtgacccggaaaccccctccctgctttgagttgtcccacctttccagacggaaccagcatgactccctaaaatgcagaaaaccaaactgtgctctgaccaccttgggcatatgtcatcaggacctcctaagtctgtgtcatgggcgtgtgtcctcaaccttgacaaattaaactttctaaattaactgggacctgtctcaaattttctgggttcatatttggtaaccatggggggattctgagtggaggtgcccctgagctttgacaaatcttgtattgatgcttggtacatcatgaactaatttattgctcaaatcaataggacaatttgctgaggtctgcgagctgcccctccagagaatccctgctctcccaaaatttggtcaagatctcaagtttattttggtgtacaactcctttattttggagttttactttcttccaacaaggaagggaagttttcctgcttccgtgataatggaaggcaggtaactcctttatggagtttgagctcacttccaacagcgaagatgagatttttcctgcttctaggatggtggagagcagtcttcagcctgagacccatccctgggtaagtaactgaattggggtttgtcttggctaaagttaaagttaacaaccagctggtcttaatttctttttaccattagagtgttcagtgatcatgtaagttgtgccattgtttgttttgcttaagggttttttttttttttttggtgtttgtttgtttctgtttttcctactgtttctcttgttgtttcagtcttttgcccattgggtttaatcaactctatccaacttgatcaactctgaagggaagttccaaattatggggaacaaggcctctgaagtgactaaattccaccccccgcctcccctccacacacacacacaaaaggtggtatggttgggggagaaaaacagccagcaaaaggagaaaaaaaggaaagatttttgattttgactactaaaggggttttatttacagaacaaggccacttttttgctagcaggccaaactgaaacaatggcagttgccccacgctgtagttccatacctaaggctctgctttcttttcaccatgagagcctgggtttggtgggtttggttcctaaatcaagccctttctggtttgatacttggtacctctgaaatagcagcaattttttctgactaaaatacggtaatgaaatttaaatggattattttaaaaagagctcaatggttaaaagtcagtttaattaaaaggctaacatccaagatgtacgtgtgtgtgtgtgtgtgtgtgtgcgtgcacgcatatgtgtatgtttgtctttgaaaggtcttcatgtgtttgttttttggttgtttttctcctctaggaccttgccttttttttttagcaaaagtttttttcttctcagttgactgaattctgttattacctgattgtttgactaaaatagatactgcacagaggctactctggggtttttaaggaagagtgtagtttagacacttaaaaatgtctttgtttaaaactattttttaagtgcactgtaaaagcatcacgttgtctagcctcataataattcaccctttttggagacccaggattcagtgtgggctctacccagagctcagatatctggttaaaaaaagaaaaacaggtagtctctatctaaataaaatcagtcttcctatgtaatccaacaataaatttctgtaattttattactgagttggcatccatctttaatctttctctagcaccaccagacattttctctgtgtacctgataatgtaaattttgctatttgactttcacctgatatgcagatttaaggctatttagctgacaactgtctagggttctgaaacaggttatcaagaatctgaaagtctaagatatgaaaaaagaggtttttatgaatctataagatgtacttttatcagcatgcctaatatgtctgtatttatgtgttgtgtacacaatgtttcactatgaaaaatatataaaagagctctaattaattggctcaaagtgaaataattcaaaaagcagctatattcattaaatcaatatcaatgatttatacttaatacgtaaatactttatcaggaaaaaaggaaagattagtcaaatgctttttcaagtttgcataacttaagtaaaattattaataaatgagctcgctttaaaattattggtaaagtaatattagaaatgtcagcatacatttttgtttgcaattattaatcaagcaatttcatacttacccctgccaaatagtataagttgtcaaaatttggcagagggtttacaaaactataaacccggcccaaaacataatgatatttgcttgtgtaatctttaataaataagtcattgatattgatttaatgaatatagttgcattttgaatttagtaagattatcataacttctaattctgtggctttaggcagtctagtgcacaggcagtaaggaagtttgttttgagaaaggactgttatagtgtttgtttcaaagctaaactataaactaagttcctcccaaagtccaggaatgaacaaggacagcctggaggttagaagcaagttggagttagttagtcaaatcttttttccctatctcagttataattttgcagtgatggtttcataactttaaatcatgactatcacagttttcataaacaatctaggtaaacaaggtaattaggtaaatgtaatgtgatacatacttgtagacaaatttgtcataatttagaatagaaagttatattaa

SEQ ID NO: 936 - DNA, 1872 bp, Homo sapiens
gtagccttttcagattggcttctttcacttagtgatacgcgtttaaggttctttcatgtcacttaatggcttgatagtacatttctttttagcaatgaataatattccattatctgttcacctactgaaggacatcttggttgcttccaagttttggcaattataaataaagctgctaaaacatccatgtgcatgtttgtgtgtgtgtgtgtacacaagttttcaactcatttgaataaaaggagtgcaactgctggataatatggtaagaatatgtctaattttgtaagaaaccaccaaattactttccaaagtggctgtaccattttgcattcccacttgcaatgaatgagagttctattactacacattctcaccaggtttggtgttgtcagcgttttggggttttgccattataataggtgtggggtggtatctcattattttaatttgcaatttcctaatgacatatgaggttgaacatctttttatatgcttattgccatttgtatattttcttttgaggtgcctcttcaggatatttttgccatgttggtcaggctggtctcgaactcctgacctcaaatgatttgcctgccttggcttcccaaagtgctggattatgggcataagccaccatgctttgtatattttccataacagtactttttcagaaatgtcttttgcaaatatttttctcccagtctgtggattgtcttctcattttcttgacattgtattttacagagcaggtttttaattttaatgaagtccaacttatcaattatttcttttgtggatcaggcctttggtgttatatctaaaaagtatttgccatacccaaggtcatctagatttgttcctatgttatcttctatgagttttacagttttgtattttacatttaggtctatgatccatttcaagttaatttttgtggagggtttaaggtttgtgtctagattctttttttctttttctttctttcttttttttttttgcatgtgatgcccagttgtcccagcaccatttgttgcacagactatctttgctctatttgtattgcctttgcccctttgttaatgatcaggtggctatatttatgtgagtctgtttctgggctctttattctagtccatagatggatttgtccgctcttttgccagtaccacagtgtcttgattactgtagctatatagtaagtcctgaagttgaatggtgttagtcctctgagtttgttctcctttaatattgtgatggctactctgggtatctttggtggtggtgatgtttgttttaaatgtctccatataaacttcagaatcagtttgtcaatataagaaataacttgctggaatattgattgggattgcattgaatctatagaccaagttaggaagaaccgatatcttaacaatattgagtcttcctaaccatgaacgtggaacattatttatttagtacttctttgttttctttcatcagagtttcatagtttttaaaaaatatataaatcttgtacatattttgttagatttgtacttaagtatttcattctggagggagctgatgtaaatgataccgtattgtgtgtgtgtgtttgttttgagacaggatctcaatctgtcactgaggctggagcgcagtggtgtgatcatagctcactgaatcctcagcctcctgggctcaagcaattctcccatctcagcctcccccgtagctggaactacaggcatatgccccatacccagctaattttttttggtagagatggggtctcatcatgttgcccaggctggtctcaaactcctgggctcaagcaatcctcctgccttggcctcccaaagtgctgggattacaggtgtgatccac

SEQ ID NO: 937 - DNA, 9133 bp, Homo sapiens
gaccacatcctgcagctcacagccagaggcaggtgcagaaggggcactgtcctctattggcctcagcctctgtggaccagatccctctcaactgatcgggtgcaggctgggctgcaggcgggtagttagtgagtgcctgagatgtgcaggcatgctccaggcactgggaacacagccttgaaccaacagacaaaaccgtctgcatgcatggagcttgcatcctgacaggagggacaagcaagaaacgaagaaataaatcgacagcattccattagttagcacctagataaaagagatatacctatagtgttcaaagcttgagctatgagaaataaaagagcaaaagatcgttttcatcaaaaggactatgaagcatgttatgttttacttaacaaaaccagtgctaaccatgttacatcctccagacttgaagtgtgtgggtgtgtttaacagacacaattttacctttttttcccttttaagttatccgtcaacatttttcagtctctctttaaagagcatcttaaatttgcataatagtcattcatcttaataaaaacattacactgttgttggacattgttgtttcctttcaggtttaactctttaaaaacttctctaactcagccgcagggtgcactgcctcatgcctgtagtcccggcacttcaggaggccaaggtgggtggatcacgaggtcaagagactgagaccattctggctaacatggtgaaaccctgtctctactaaaagtacaaaaaattagccgggcgtggtggtgcacacctgtattcccagctacttgggaggctgaggcaggagaatcgcttgaacccaggaggtggaggttgcagtgagccgagatcacaccactgcactccagcctgggcaacagagcaagatcccatctcaaaaaaacaaaaaacgaaaacaaaacaaaaaaacttctataactcagtgcagaatcgtttaaatttagtactgttgcattagaagagagtggcagaagcaaaactacagggtcgaagggtataaacattttaaataaacaggatatgaaaagttctaaagctcttgatgaagattgacaattgctttctaaaggaatctactctcaccagccacatatgtgggaatgctcgtttaaccagttcctcgatgaatctgagcctcatcttccccagtgggagatgggagctcactgatcctctttcatttttgtctgaatttaagggaaaatttccaaaggacacatggtagaccagttccgtgatctactcaaacaaagggcggaaactgtctctccacattgcagagttccacagcaggaggggaatgctgagtttcaatagctactgcaggaggggagacgaaaacccaccagggcatggagaagtcttctttcttcctgtctgttttcagggaactcaactagtcagtaagtcagaagcagcaacttggcaggggtggaggtgggggctcagtcccaatagcctagaaaagtgcctcctctgtactctgagatcttgtcacacacaaacccagatgagaatcagcttccctgccctgaaaattctggggtctcagccccatgaaaaaataatttcttgcctcggagagcaatcgtgaggataggaagggccaagacttaactgaactctcaaacaccgaagtgcctgaaatgtgtcctgctggcagaggtgacctcacaggctgcaaggcttgcctctcttggagtatatggtaggaacatgcagagatgcactttttggcaggctgacctaggagagccgatgttcaatccaagcagctccaaatgctgaagagaatacaggggtatttgatggggggatgggatggatagcctgcgacagaatgccagccttcagacccaacctagtgctgaggtgctgatgtgcgtgcacacccacccgttcccccagagcttgcaacatcaagactggcctgtggggatctggctaggatgtgcactgactgaaatgtctttaggccaaatcctcttaaatcaaaagtataaacagtgaatttccaaaccctacagaaacctcaaatgagaaatgacagagtcagaaaatggctaatcctccaagtttgtactggaaggtctgaaaaaagatagaaaaaaaaagggggggcctggtatatatttgaaaatccaaaatgacacatcttctcttggaagtgacacttggctggcagatgcccttatataaatatattttctttcggtaattttcaaaatgtgaaatgtccttaaaaataagaataaatgacttgcttcctcctgtgggattactgcacctgcagagtgcagccagctctcatgctcccagacaccaccccaaatcctcatcatcctgagatcaacctcaactactgtgttgagttttgtctcacccagtgtacgacccgcctcctgatatgcatttcactcccactgctcaagcaaagacggttgtcaagacagggctagcaagagtgtttattgagaaagatgaattcacagagattttgaggttcctggctgagtgatggagacctcaaaaaacgcctggtgagcgatttcaggaccttctgtccagagggaaagaccagaacaacttccaggtgagtcctgccgcttcacagggggagaagtgtcaccagattcaatgcaagggttttgtgagtgagaagggcagggggtctgacttggagaaggtatttctctgaaagcaacggctattgtgggagacgggagaaagcacagccagaaatcagaatggcatttgggggtctgggttagatattctggtgggttctcttcccgatgggacagagaaggaaacccacttcccttctgtctacttggtgaatctgcgggtctccgagttgctgtctgctacatctcatagcacctatcttggactggacaaaattagctcaggtaccctgcaggctgagagggaacagctagtcacaggagcctggtttaggggagttcaattgttctgaggttccggggaaaccgatggaggaggccttgggagtccaggcagcgcgcgaggaaatgcgatgccggcccgagcagcttgctgccgccagaacaggcgcgtctggggagctcagtcccctccgggacctctggcctcctctcgatgctccgctgccgcccacctccagcggcccggggcagctaccaggaggccgaggcagtgttcgcggcctgggcccggcaacggaacacggaactgtcgtccctggagagcgaggaggctgagctgatccttcgcgccaggcggccggtgcgcccgcaggccccgtccagcgcccgggctcggaatgagcggtccagcaggaggtagatgagcgggttggcgcagctgttgacgaaggccaggcaggtggcaatggtgaggccccagcgcagcgccagcagcagggggcacggcagcggcagcgcccccagacgcgccaggtggaagacggcccgcagggcgctgaagggcagccaggagcccacaaacgtgctctcgatggcgaagatgatgcgcagcgagttcctccgggcccgacccacgtgcggcggccgtcgcaggcggcgcgagatgcggcagtagcagaagagggtgacgaccaggggcagcacgaaggtcagcagcagcagcagcaagctgaggccctggaaggcgtgggagggctcctcgccgcactggctgtcctggcccccaggcaggggctgcaacccccggtagaccagggagggcaggccggccagcagcgccacggcccagacgccgcagcacgaggccagcgcgcagcgcggggtgcgcagtggcctcgcctcgagcagcttcaccacggccaggtagcggtccacgctcatgcccgccagcagcagcgcgcccgcgcagcgcgtgcccgccagcgcgaagctgctgagcttgcagaggccatcgccgaacggccagcggccgcctagcgccgccgccgcggcccacagcggcagcgtgagcacgaagcccaggtcagctgccgccaggtgcagcacgaaggtatccaccagccgccgcgggccccgccgcccggccagcagccacaccacaaaggcgttgcccagcaggcccacggcgaaggccgccaggtagagcgcggggatgtagacgtagccgtagggcaggtccccggccggacacagctccagctcctccaggccgtccaaccccgagtagtcccagggcgctgaccccgggctggggctccagggctctgtgggggccatggcctggctatgaggcctgcgcggagtgcagccctgggcgcaggcggcagcagctctgagcaggagggggtttgctcttcacgcccggccctgcacctcccttcctgccacccaagccggaggcaaatgggtgggcaggaaagaggggagggaggaggggatggggtgggaggggcaggcttctgtgagagagatggtggcctccgatttggggctgacccgaggggtaagggcagggacaggcaaaaggggcttcacatctaaatcttgggaggaaaagtcttcagggctgggagacctgcccggcctcccagtaggagcgtggcccattcctctattagttgctcagtttctttgttcgtgaaatcgggatacttgccccactgtctcagggtcgcgttgcaagaggtggtgggtgcccgagagccctaacctcttctcagcctccacttcaccccttcccacctgcacccaccggctgctgtcttctctgttttagaggtgagaagacagagccccgggattttatgagtatggggcctaaggcacgccccaccccaaatccacctgttccctaggaaagactccactgccgggacacagcagatctgggtgggtgggggagcccgccctgggcagtcaagcagttgttagcgtcctgagatgtggggctcatgtcttcaccctatgagtggcttctctgacccagtcaggtcctcatgaagccacgcgaaagggttttaaggcagcgaggaaggggtgtagtcagatcatcctgctggaaaggggtgaaacctgggattcacatctgcctcttccctgtcttctcctatcctaaaaaacctgtcaagccagacacagatgtaagctcagttcaaaagatgacacctaatgaaacaccagattagttgtcctaaattatgagtcaggagcttggaggcagcaagatcccttctgaactgagaaactgagagtaaggggaggattcataaagacgagggggaatgaagtctgaccctgaggaggcagtgggacctaaggaggagaggatgggtgagggaaagcttgctctttctcctgaaggaggcatgcagccacttacatctgaattcttcttagcagatatcccttccacaagatattgtggtagaactgatgtcacagtgccctctgagtctgtccccagtgttcccaggtatgagtggctgatgtgccgggcaacccggtgtggaaaatttgaggtggattatcaattttgttcgattaagacttgttaacaatgaactcctccatgaagcaggcactgtttcaggcactgcaagagatgccattcttggccttcgcagtttgttgcataggcaggagagatggttacataagcagaatcttatgtaatcttatgcaggggccaaattgtagtaaatgttaaaaaccaagccctcttagggtttagtggagggggagtgattatttttgacgggagggctgaatcagaaaaggccttcgaggagatgacacttgagatcagtcccaggaaggagctgaaagtcaaataagagcagcagaaaagagaagaaagggtcagactcggaggagggagtaaagggaacaagtataccaaaatgagtaggaatgtgggcttttcaggggacaagcagtctgccagagcccagggtaggaaggtgggggcaggagatgaagcaggaaaggatcatgaggggatttggatttcaatctataggtcatggggagccaggaggcatcgatctgtgttttgaaaagatcgctggcagaactatggagaagggagaggctcaagccagggagaccccatagtaggttgtaattatttgtgtctgaaatagatcatgagcagtggggacagaaatgggagggtatattcaagagataattgtaacatcataggtctcacaaagaggagtcaaagataagcctggggtttctctgcttagggactatatggacgctgtccccttaactgccaagaacacagagaggcacatgtgtgtatgtgttcagtttgatgttgaagtggggtcatgaaataatttatcatctaaccaggatgtttctgagagtgaaaggggcactatcagaattaacctgggccgtaaaccaggactattttgggcaaactgggacataaggtcaccctcgctcagggtccctctggcacacggagatccccaggaaggatttggaaaatggtcttagaggccgggcgcagtggctcacatctaatcccagcactttgggaggccgaggtgggtagatcacttcaagtcaggagctcgagaccagcctggccaacatggtgaaaccctgtctctactaaaaatgcaaaaattagccgggcacggtacgcgcaagtcccagctactcaggaggctgaggtgggagaatcgcttgaacccaggagcaaaggttgcagtgagctgagatcaagccactgcactccagcctgggtgaaagagcgagactccatctcaaaaagaaaatggtcctagagctcacagagggttgggtatgcagtgtttaggctgctcctgtcaagaatttctcccacaccaattacaagatgggcagggaagagaagagcctagggaatgaatggtctggaccttcccttcactggcttttcagcctccgggcttggttttcccctgaagacccaccccagagccgcttttctaatgtctgagcatgtggttgctggtgagcggtgcccacatccggggtggagtagggggctgcagcctcctcccctagaaggctagcaggggcagtgcttgcctgccagagcccagagaccatcagagacagacccagtgttgctggacttcaccccttcaggcacacctcagtctgcgggctcagagagtgtgagtgatcctgaaagctagagatgaacagcagagaagccgccgggtgaaaacaaagaatggggcaagcagaccaagaggggaatataggaagggggttgaggggaagtagaagtaggttattttaaaaatcacagagctacttgcttcctgggccatcatctcatacccaagggaagtctgtggcccagagcatatgctgaattttctctgctgaggcctgggtgctgtccatgggccttactgaacttgtctggatgagaagaaacagcaaaggtcagagccagggacactgccttaggcccggtctcctggggtgcccagcccggtttcagtgaccaaggccaacttcacaagactgctctttcacccttcaggaggactccccacaggattacacacaagtcaactaatagaaacactcacccttacaggctgggaatcctggccatgctctctaacaggtgtggacaaagcagaagaagtcttccctcttcctccatcccacccctgggagccttctctaacctccatccctaagaggacttcctctctctgcactgctggagccagggcaactgttacgtggctccgtcttgccttgcccatgggattatgaacttctcagggcgagggggagcttctttctactcatcagggtgattagcacaagcctgaaaacagaggagatactttaaataaatatccaatgcttcgggctaaattgttttcgagagtaggtttatttctgcccctttacaggttatatttaagttcttataacttattttttctaattttaatttttctgtacaaagaatcttaacattttaagtaaattgtatttgcctttttatgtttaatcataaaagccatctaatacattacagaataaagaagtagtcgtcatcttggacctgctacccctacacaaccaaacttagccagtgaaggacattttcaaaagtatttatttgtaatctcattatttttagattttctatttttaaatattccatttcagatattcttcacattttttacacaggtgtttcaaagtcgtatctgtaattagagtgtacacagtattctcaattaatatcatataaatccacatgagtctatgttgcttaattttctaaacccttaaatatggatatttaggatgtttctagtatttttaactgttatagaaatttgtaatgaataattgcacttatgacttttttatattgtttttataacataaatgctcttgtataagtacatataaatatgtatttatatacatataaatatgtacaaatataacatatttatataaatatgtataaatataacatttatataaatatgttgtaaaacacgttataaatacaaattttgtaacaaaggcaatgaaaatttttattgcttgatacaaatgtttacagtgattagcagtttagaatgtcactggcattgtatgagagtataaggttcaacacagtcttcttagagatgttcatcggtaacatatattttccattgtaataggcagtgaggtaaaatggtacctcatttcaatttgcacttgtttataaataagatggaaaatctatttatttcctaagtgaaccattctaatcatgtccttcacatatttattataatctatgtatttcttattaatttgtacaaactatatatttaggatgagtcatgatttattccacttgattcaaatatttttccaaattcttttcttagctattatttattttagtttgacattttcatatagtcaaatttgttgctattagcaatttcagagtttagaatgttactttctctttgacaatgtaagaagattcagtctgtcattaaaaaataattttcattagtattttaaaatttacctggtgtgtaatcgatgttttcatatttctatccagctttcctaacatcatt

SEQ ID NO: 938 - DNA, 1440 bp, Homo sapiens
cattgaactgcaaatccccagttaaatcaagattgtgttgattaagctatgtctgatttatggcttaaaagtcacttggttagactcaaacattgttgcaacatgctatatgttattcttaactaacattatacaaaatgcacaataaaggtagataatgaggatcttacacgttatttgtacatttattgaatacctatttataatcacgcatgatttctccgcaactgcattttctccagttaaaaaagaaacaaaaacaatttttttaaacccttgcaagagcaaagaaacaaactcaaactatctcttcaatataactgatttagactctttccatgttacaggtatcttgcctgactccaattcatgttacaattatcactgcaaacatcagcatcactttttgtgggactctcttatttatcatcccctgctttaagaatacactgtgttccggttggtattctcgggccccacaactcatagtattccttctggtgttaattgcttgttgatttgccttgttctaaatgcccctatcatggtcttttccaccctaagtagctaaatatattcaacgctgtcaaccattcctcgattcactttatttccctgaaaaaattttttatgtcttcttgcaaaaagaaatcttgtagtatagtagaattaaaccatgctgcatttataaatatttgctctagtgtattgatggctctcttaaaagctgccattcaggccgggtttggtggcgtgtgcctgtattcccagttacttgggaggctgaggcaggaggatcccttgatcccagagttcagggctacaacgagctatgatcaattgagccaatgcactccagccttgaaaaccctgtctctaaaacaacagtaacaacaaacagccattcagagtaaatagtaggtacaaaataaaatactccttattgtatacctagtataatacagaagttaagaacttggtttttcatatgttagtgtgtttaatatgtactctttagtaaacaggtactggtagcccttggcttttatatcattgacttttcaaataactggcacatggaatactatacgtgtcacctctgaaatgccatttatatactggattttgacttacgaacatcatttgatgaatgccttttttgggctgtttgtgttgctgtcttgccaagtaacccccacctgctacagaactgtgactttgccacttttggcaaaaatttcaaaaattatttggaaaattttattgctttttaccttattttaacaaaacaagtggaaaaaggggaaatgaaagcatctagttatgagaaagtttattatcttgatataaaattgagacaataatcattagatgtgctgaaagtgatgaatctttattggaagtgctgcatggagttaagctgatgaattgtgaaaaaaa

SEQ ID NO: 939 - DNA, 1989 bp, Homo sapiens
cactacgcccggctaatttttttgtattttttgtagagatggggtttcaccgtgttagccaggatgatctcggtctcctgacctcgtgatccgcccgtctcggcctcccaaagtgctgggattacaggcatgagccaccgcgcccagctgttttgcatttttgtatgatttccatccttcactttatgaaggacattatttatcacattaatgatcaaatatatttatcacaataatgataatagaaaattaaatatttacatttttgtatgtgtgtcttttgggagaaagatacatattctgcattatcttactagtatgaagccttctttatctatgtctgctgattgtgtacacctcggtgccagacataaggaaaaccagcataggccccagagcctgatgtgtaagttctggtcccagatccatcgaaggccatttaaagtctctgaaaatccactctttcatatgtaaaatgtgatcattaagaattgttatgcctacctcataaagttttggttagaatcacatgagatacatgtgaaaatgctttgtcaactaagaacgtgttacacaaagacaagatatgtattattatggttattttctatttctctagtttgactagtttcattctttgcaggacattttcatttttagatgttcttagctattttgcctgtggtgatcagaaggcagatgaaccatggggttctatttctctgactctagatccttttaaaaagctggtgacctttttgtctttcttttcttgttttatcgtttttttttttttttttgaaaagtggaaaaatattctcagggtatattgaattgattgagcctcccttggatttctttgacttatttgacttactctatatcttgcttctttactcctctaatttaacattttcctctaaaccatcatcagaatgtttttgcactatcattattcatttttttcagttacagaatgtgggaaaaaggagagaagggggctgttgaagaggaggcttcatagaataatgaatctggaagaattcaaggagaaagcgtgtttgttgtggttcacgttaaaagagagagatcgttgcagaaactgtatgctgagcccttgtctgggtcgatcacagcaccagctttctctattcttggcctggttgttatgagaaagttgctcatctgggctggctgttcccgaccaaaatttatgctgatgacctcaactaggacctttctgaagtgcaataatatttttagccttttctaactgtccatgaatcatccatagctttccactgtccttagacactacccctaccatcgtcactgtctgcctcttctcaccttgcagcccgagttctactgaatccagaaaacccacttacaatcctgtaccacaatctgtcttccttttctttctcattaatattcttgagtctagttccatttttaaaaataaatgttttattttagaatattttagatttacagaaaagttacaaagatagtacaagacactcctatgtaccccacagctggttgccactattattatcttacattagtatggtacacttgtcacaattaatgatccaatattgatatgctattattaactagaatccatgctttatcatatttccttagtttttgcctgttttttcccttccgggatttaatattacatttagtggtcatgtgtccttaggctcccctgacttgtgacaatttctctgactctgtttttgatgaccatgacagttttgaggaatatcgatcaggtattttgtagaatggcctctgttgtgattttcctgatgtttttctaattataagcttcgggttgtgggtttgcgggaggaagatcacaaaagtaaagaaccattttcatcaaaagacatacggtgagcacgacttaccactactggtgttgacctggatgaactggctgaggtcgtacttgccaagtttctccaccataca

SEQ ID NO: 940 - DNA, 6595 bp, Homo sapiens
gggcagcccccccctccgcgcgcccccgccccgcgcgcgcgccgcgcgccccactagcgctctgcgcgcgccgcaggctgtagccggccggggtcgcagcacgcctccccgctccgccccctcgcgcgccgcccggcgccccgcgcacgcgcgccgccccctgctccttcagcgagggtctgcggggagcgcgcgtccaacgcaggtaatgatgaaactcctgctctggtccgggctaccggtgaacagcgcccagcgggccgggcccccaacctcgctcctgagcctgaacatccccccaaccccaccgtgagaattcagcgaagagtaaaagctggaaaaagttgcgtgtcttaggctaagcagaacaaagtggggtgacggctccccggctaggaacagagatgcccttagggagccctctgatggaagagctctccgcttaagaaggtcaccactcccttacactcaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaattgatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaatggcagctctatgtatgacaactttataaagatctgccaaaaggtatgatgccaagctttgcttttattaaactattagctattagcactgaaacgatgttcagtagagaagtactctcctttcaatatgtgagtggaaacacatttctctatggggactgctggtcagggactcactctaaagaaaagccacagtgttgtggttcagagcatgggctcaaaagacaaatggataagaagcccaagaccagtccttctgagctgtgtgaccttagacaagttgtctaatctctctgtgtctcagctctgcctcagtgttgttaatgggattgccgtgagagcaatgctgtaacatgtaaaaagcacttagaactgtgtctggcacacagaaagcactcgataaatattgacctggttagcagcagcagcagccatcgctggagcatctctacatcatacagggcccgatggaaagagaccagcactgagaatgaacagaacagtgctggctctgacccgctggctctggcattgctgaataactctaagcaagtctcttaagctttttaaatatgatttttcaccagtaactaatgaagggattgaaggagcaggtcccctgacgtcttttcaaattctaaaattctccagctttatttaatcctgcagtgaatccttttgcaaggtaaagagtactcgctcccctcaataacatcttatgagtttaggtttcggtgcatagggcaatacccagggcataaatcatttccactgtcaccatagcccgcaggtgaggtgagcaatccattagcttgcttctggaaacaagcctgtctgtatttgttcccccagcatctgcactcagcacactgactttgctcagtatatgtattggatggataagtgagtaaatgaatgaatgacataaagatcatagattgcctcagccttctattggaaaataacctaaagggagggggaaaattactacttaaaaccacaagtgccactcaagggatgcctcctatgaaaggaggagtgctaactgccaggtccccactggttcttcgtgctgcttatggcctggaaggcctctcctgcagccaagagccctgatgtgcttgggctgtgcaacggtgagtctggggtgagtctgggaactttaggcgcaggaatggagagcgctgactccctttgcctaagaaaggggacttagaggggaacttgaaagagggagtaagagagagggcaacaagaggggccgaggctaggcagtccatgcagcgggtgccaagcctgaggtggggtggtctggaaatcattccagaacaggaaatatgttcttctgtcttctgtgccattttaagttctgtacagcaatgcctgcttttccagtgatccttacaacttcccagcttgtatttgtgggtactttgatggaaagttgcaggggaagcagggaactagggctgggatcaataccaggaccaagataaaggaacagctgtaagagcaagagaacaagaactaagcaaaagcagggaatttggggcctgccatgatgatgggaacgtgggctctgaagatccacagacagccaaggcaggcctcggcctctccatgggactggaaagctcatcttgtctccctctcaaggagtaagaagatgacttctggatacgtgagtcacaaaaggccagaacttttctgcatctcccacggcacccccttacaagggcaggtcattttggggcatgccacctgggccagtggcagcaggtactgagcaaatccaccccccacctctcagagcttgtctcttcctgtcctggccaggtctgtttcttctctcttgatcaacagaaataactcccaaactgcttggtatagagcagttcatgaatagagattcaaacaggtcacactcaattatgaaatcagggtgcctgggccaggcctggcataaccctgatctcagaggaccacccctaccctccccagggagccaccagagaagctgtcacatgctcctaagacgtgcttgccaccagcacccccagacacttatgtgctgaaattgccaacatgcagattcggattcagaggtccaatcagggcctgagaatctgcactccttgcaagcccccaggtggtgccaacacagcagaaacattgacatcttaggccccaccacagacttaagccaaatctgcactggaacaagatgcccaggcaatctcccaccctgaagttgttcagactggcctcacttaggggagggagttccagattagagaaaggtcagatcagcggagcccagatggacagccaccagacaaaggaggagaggagggagaggcaggtcagagagatcagccggccttgattctgcagcacctggagccacagtgggaaattgaagctatcctcggggcaccagaaagccagtggaaggtttccaagaggagagtgacaaaatcagatggaccattttataggattcttctggctggggatgcagatccagttggaggcagggggggatagttgaattaagggaggcgctagagagagctagggtagcagtccaagagacccagatgagggtagctgcagtaagcagaccagcacatcactcatggtccagggtgatttgcaggcctctgaagcagccaagtacaaaacgaaggccctcccacttcccttctccctggaccagatctctctgacttctcacctggaaggtgcccacaggttgccaactccttgtcctgtttccaaaccctccctccttcaatccatctgacactctcctgcccctgctcaaaaaccttcaatagctccccattgcctgccaaatgatctgctaactcctccacccacactgttatgttctacttctatgtctgcctaacccgtgacacagtagttcacactttcattcatgcaacaaatatttattgagtatcatcaatgtggcaggcactaaaaagaaaccactcatctgccaaggcacataatcaatttcaggaggcttatagccacactgaaatgctcttccaaataagtgctttggctgtagcaaatgaaaataataatagaaaacacttattaaatactaactttgtgccaactatcatgttaaacactttgtgggactatcttaataatcttcctcagacacctataatggagagggttggcctcatttttcgttttgtgggtttttgttttgtttgtttgagacagggtctcactctgtcaccaaggctggattgcagtgctgtgatctcagctcaccgttgcctcaacctcctgggtttaagcagtcttcccacttcagcctcccaagtagctgagaccacagggatatgtcaccatgcctggctttttttttttgtcttttggggggtgctaccatgttgcccaggctgatcttgaactcgcgagctcaagcaatccacccgcctcagcctcccaaagtgctgagattgcaggcgtgagccactgtgcccagctggttgggctcattttagccaaaagaaaaatctcaagtcacttgcaacgtaagtgcaacaactaaattcatagggtatgaattcaggcagtctcaacccaggacttctccctcaacccctgtcctctgaatgtccttgtactctaagtcatggggctgtgagtgaaacaacatcaaataaggcatgttaaagtgcacaataaaaccccattcaaattctctttccgactcacctcatgctaatcccaagtcctcccatgatgcccgggtcacaccgaccaagcaattccaaccttgagggttttgtcttccttttccatttgcctggaacactctccttcaaggccttgttttggcctctcaccattcagatctctgctcagatatcacccctggcatctctgggagagaagccactgagacacttgtaggcaataatggaaatctgccaaaaattctcttggtgggctcctatcacgttctaagcccttttctcctgtttccttttttctgtcttcctctccacttcctcccacctccccttgcccctttagcccttcaagaacaagtgcctctctcttctcctccgtgttctcctccttaatcaaaagctgctctcatcaaaagatgtcctgtccatcatatacgccttagtgtgaatttgttggtaggtcaattttcccagaaatgtctgatttatttttattttttattttttttttaatttttttgagaccaggtaagtcttgctctgtcacctaggctggagtgcagtggtgcgatctcggcaatctcagcaccctgcaacctcaacctccacctcccaggttcaagcgcttctcctgcctcggcctcccgagtagctgggattataggcatgtgccaccatgcccagctaatttttgtatttttaatagagatagagtttcaccatgttggccaggctggtctcgaactcctggcctcaaatgatctccctgccttggcctctcaaactgctgggattacaggtgtgaaccaccacacccggccaggagtgtctgaattttaaaccatatgcttgattataaaatagtagagtttgcctttcttaaaggaatttcatacaactgggttgctagtttgtgtgtgtgtgtgtgtgtgtgtgtgtgtgtgtgtgtgtgtgtgtgtgtgtgatatgttaggggcagcaggtttttccttaacgccaggaatcattcaggctgactttgttcagctggaataatttcaggcatcgtgatacagttgaaaggaaagaggatgaacattaaaataaggaaggcctcaatttgaatctcgcttctgacagtactcgaacgatcttagactaagtgatttcactctgactcccagttgtctcttttataatgtgagggtaattaactattgtaaagattattgtaagagctagatgagatcacaggacacaccataagggctcagtggggctggaatgcgtgaagtcctctttggagcagtcaggcctgatggaccccgtgcctgggctcgaagacacctacacacactcccagggcccccactgcttataactgtttctggaaagaactgagcatgaaacttggcaggagaccacaaaacgtcctggaatcctggccactgtcaagtctagaatgctctcctccagagaatcacattcttggggccagtgttggagcatggaagacttagttggggattggaactgctccagccctgaagccctccttcctgtccctgtaaccagcaaatgtcactgtctgtcttgccaggctaacaacctttctcataagcatcaccaaacctgaccagacatcagtcctctgaaaagaatcataatccagccaccataaacccaaaagccaaagtggtaattatctaaagatgaggaaaggtttcctcccaggccctccaggggccaaggaagttctcacattaaacagttacactgatctccattgatttcttcagtccatcaaccaattattggcaactttttcttggaaacctactgtatgtgag

SEQ ID NO: 941 - DNA, 1279 bp, Homo sapiens
tcaagatattgtgtccttgtcattggccagagatagataggagaaagcacatttggttcttaagagtagggaattgtgtggaagttattggttttaaggtaccattacagataatctttaaaacttgggtgggatctcataaggtgatgatgtagacaaggaagatagaagaagcagagggataccatatagggaggtgtttgggatgaaggagtccatgcaaagaagtgagaaacaaggctggaactatatagtagagatctcagttccagactaaggaataatagaactgatggcatttatggaacacttactatgcaccaagtactttctttggagtatcttaatgagtccttacaaactcccctatgagacagtcttttgtgaatgagaatcagagacacaggagttaagtaattaatacagagtttgtaagcatagcaggcattgaaacccagtctgtcaactccagaacctatgaacattttatccactgtgctgccttatggtcatcaactttactacctaaagttgctgattcctcagacctagagttttgcagcctcctacatgatggttttatttttcaaatagcacaaaaatagccctttgtgagatttatgtaggtaagagggaacctctgcccttttgagacacttagccttctccaacccaagttagggtatctttgggcctaatatttctgctctcggaaagccctagaggtcctaggcagcaatagtctctttaaatgtttatttattgcaagggacaatcagggtcagctaatccaggacctgtggcgaggcatgcagagcactgtggccaggctctgctcatggtacacacaccccagggccatgggcttttcaccccaaccccaccaaacttgctaaaagtgttagatctagtctagaagcctgaggtaactcctagatgtaaaattcaggatataggcccaagaattcctgcatcccagcaagaaggaagccagactgtctgcttttacgaactgaattgagaattcacctttccagtgagactgaagctttgctgaagatttatcgccccctggaggacaatagtataatatatctcttcaggtactctagaaaagatgcccaactgaactgaaatacacatttttttcctaaagaataggaaaatcaagcctttgctaagacaaccctttaaaaagatgtccaggcatccaaatggcaggagttctctggatctgacctcaaaagctaggcctgaaatgaatacattgtgggtctct

SEQ ID NO: 942 - DNA, 1939 bp, Homo sapiens
agactccgcccagccaggagtcccctgaaggctgctggaaaaagagcaacctggcacccggaataatgactctgcctggatgcttagagcagtgcgagggactcccaagaagcccctagcccacttgggggaccagggaggattaggagttggtggttgagtaccgaaagagttagctaggcgaaaaggggcgggaagggcctcctaggccgaaattgcatggaggaagatccttaggtagaggaaaatgagaccaggcttgtaggcagaagcagatttgcagtgaaacaaatgaagcttaagtttcgggacctggccgggcgtggtggctcacgcctgtaatcccagcactttgggaggccgaggcgagcagatcacgaggtcaggagatcgagaccctcctggctaacacggtgaaaccccgtctctaccaaaaatacaaaaaattagccgggcgaggttgctggcgcctgcagtcccagctactcgggaagctgagggatggcgtgaacccgggaggcggagcttgcagtgagcccagatcgcgccactgcactccagcctgggcgacaaagcgagactccgtctcaaaaaaaaaaaaaaaaaaaaaaaaagtggaggcgtgaataacccaccccttgtttagcgtaccatcaagaaataaccataaaaatgggcaagcagcccttggagctgctctatctatggactatccattcttttattcttgtactttaataaacttgctctcactttgcattgcggactcgccctgaattctttcttgtgcgagatccatgaacctctcttggggtccggatcgggacccctttctggtaacaatgcctgtaatcccagccaatctccctgccttttgatctccctgcctcactcctacccaccctgataattggctgttgaatgatcatttaaaaacacagtttctgatcatgtccctcctctccactggatccctactggtgatgtcaaatgttgtggggcctaacgcttccgcaatttgagaagacatagttaagaaaaataatacaaaacttggccgggcgcggtggctcacgctgcccccagccgaaagctttttcttatttggcatttgaatgtggaattttggaattttcttattggcaacaaatactgtcagttattttccttgaagtgacaggctcactttgttcatttttcaagaaaaaggctggccggcactgtggctcattcctgtaatcctagcacttgggaggccgaggtgggtggatcacctgaggtcaggagttggagaccagccaggccaacgtggtgaaacccagtctctactaaaaatacaaaaattagttgggcatggtggctcatgcctgtaatcccagctacttgggaggccgaggcaggagaataacttgaaaccaggaggcagaggttgcagtgagctgagatcatgccactgcactccaggctgggcaacagagtgagactctgtctcaaaagaaaaattctagtatattaaaatataattgattttttctgttgaccttgtatcctgagaccttcctaaactcaattattacttttggtaactttttggaaatctgttcaggttttctatgcatatggtcatgtcttttgtaaataaagacactttaacttctttcttttctatctatatcccttttttttttctttgctttattccactggctaggacttccagtacacagttgaatgtaagtggtgatggtaggcatccttgccttgttcccattcttaagaagaaagcatttagtacttcaccattatatatgatgttagctgtagttttgtgtgtgcgtgtacctgcatgtgtatagatgtcctttcttaggtttagaaagttcccttctgttcctagtttgctgagattttaaaaaatcatgatagttgttgattttcc

SEQ ID NO: 943 - DNA, 1395 bp, Homo sapiens
ctaacgaggaacactaaatattgtttcctgtgtgcataagtcacttgcagatctagaagaaggagtttgcccaattttaaattagaggcaaagtacttttcttagatctgcaatttacatctctaatttaaattgcccaattttaaatagaggatttttttgttgatttgagtgaattctctgtaaaatgaagatttttaaatctgctatatatacacacatgcacatacatgtgtagtaaatattttacaagtatgctgccttttattttttctcaaatgcagggtaatttttgttttgctaaattaaccttcacaatgcttatttctgagagtcttagaaaggttttgtcaacataaaaatgtatctgtgtaaataggcatttatattttcttctgattttttttcattttgtatattaaaaatttttaatctatattccatcaggaacttatttcttttatgtactgtaactttggcatttttttctagagatcatcaaacccaagagagtctagattttctcctgttattttccagaagttttatagttttgtatttgacatttaggtccgtgattcattttgacttaatttttgtgagaaggtaagatctgattcattttttttacatgtgggtattcagttgttccagcaccactttctgaagaaaccaacctttgtttcatcatgttgcctttactttttcatcaaagattaattaaatatatcgatgtgtcgctatttctaaactctctgtcttgtttcattaacctgtctattctttcatcaatatgatactgccttgattaccgtagccttacagtaagtcttgaagttgagtagtgcctgtctgtcctccagctttgttctccttcaatattgtgttagctattcaaggtctttttcttccccatataagctttagaattactttttctatatccataaaataatttgcttccattttgattagaagtgcattgaatctgtacattggtaagaaatgacatcctgatgatactgagttattctattcatgaatatgatgtatcttctccatctcttcagttctttttttatttccatcatcacatatggacagtttatgaaattacataactccctctaccttgaccaaaggacagtgatgaattcctcgttctgcagccaacaagtcacctctgagggccatgtgtctaaacatagacaggagggacacctgttgcttcagccaacacctgctggcatgtgctgaggatgctggtgctgctggctttcccagccctgcccccggggctgctttgggtgtgtgcctcttgactttagtgagaatgtactttttcatccctaccatgggtgaaaagttttcacaaataaaaactttttaaaataa

SEQ ID NO: 944 - DNA, 1964 bp, Homo sapiens
tgtgtccagaagaaacaccctcaggaacagcacccaaaatcacactgaaaagtggtttagtgggaagcactggtaggcacagacagctctgacttcagcaccattgtcaccaacgtgaccaatgctggatacacgactacagcctcttatgctgttggctctggaaacaggatgtaactgctgccattatccccagaatagattctggagggagctcatgatttgaagtctaatatgggtacatctgtttggctgcatctctgcatcaagagaggctgggaatgagtatctgatttctgtagtcagaggctattgccacatcccaccaagagctatagagcagggagcgcccccaaatggaggaaaagtgtttactgggcaaaaagaatcaccaaagtctacaaagcctttgactacccaacatcagcaagtacacacacacacacacacacacacacacacacttaaataaacaaaacaaagtaacagaaaataatatttataaaccccttttagcccacatacacacaaaaatactcttttcaaaaggggatcaggacacatcagttactgcatccagctccaagtcagcttccaattccatcccagggcagatcacctatgtcttcattccagcttcttggtggctgggaaagtgagtttaccgatcaagtgctgggtggctgtgatgttttacaaatgtccaccagagtccatgtcagtttctctcctcctctccttctctctccctgtcattccttctctcctgtctctcattctttctctctctttctctctgtcattccttctctccgtctctctgtctctcattccttctctctctcattccttttctcctctttctcgttccttctctctctttctgtcattccttctctccttctctctcatttcttctctccttctctctctcattcattctctttctctcattccttctctccttctcactctcattccttatctacttctctctccctcaatctttctgtcattctctctctcattccttctctacttctctctccctcaatctttctgtccttctctctctcattccttctctctttctctctctcattccttctctctttctctctgtcattccttctctccttctctctctctcattccttctctttctctcattccttctctcccattccttctctccttctctttctctcattccttctctctctcactccttctctcctgtctctctcattccttctgtccttctctctctctctcatcctgtctctctctctcattctttctctccttctctctctcatcacttctctctctctctcattccttctctctctctcgctctctctcatcccttctccaatctgcatataaggggacccatacagttcaaacccatgttgttcaaggctcaactgtaattgtacatgtagaaaatctaaaataatctacggataagccattagattataataaatttagtgggctccctggatacaaggtcagtatacagaaatgcattgtatttcttcatactaagagacaaacaataataaaatgaaataaataatttatgatattagaacacatcaaatacctaagaatatatccaggaaataattttcatgacactgaaactacaaagcattgttaaaataagtgaaagacctaaataattggagagatactatgaattgaatcccaaactgttgggattacaggcatgagccactgtgcccagccaaagaaagtgaatcttgattccctcctcacatcacacataaaaatcaattgctgattatgacagatttaaagcttaaaataaaacaataaaacttacagaaaaaatcagaggaggatatgttcacgatctagggatatgcaaatattctacacaacattaaaagaactgatagatagaagaaaacatttataacttggacttcact

SEQ ID NO: 945 - DNA, 811 bp, Homo sapiens
actgaggtgctgaagaggctctcactctgtctaagagagtgtcccgagcaagacaagcagtcctagatgcccagattcttgttttggcttcggatctgggcaaagggaaagcaaagcagctgtgctcagatctgaacttgttggacatgttgtgttgaaactttactgacatgtatgggtgtaaatctgccagaagctgaagaactcatccgtgatgaagatagctctgatttgaattcatagtctatgactcctggaaaatatcaggcaaaagagcagaaaacacctttaatcaagcccatacactccactctctgttggattcaacacaaggagagttccttgtgccaaagtcccaaatcattagtccaagaaaacttcctatgatacaaaaggagacgataatgcctgcccagttaaaaagaagggaagaatctcatcaagaaacaacaaagaaagaagtagaaagaatcttgggattgttgcagttgtatattcgagatgctacccagcgtccttctttgcctttgtggttgatccacaatctttcccccaaacagtggaaaacatctttcatgtttccttcattatacaggatggttttgcaagagtaaaacctgaccaagaccgactgcaaataatagagcctgttaatattaatgaagaaagtgaggaaattcaccaaaacacccaagttaggaatcgaggaattctagctgtgaggtaccctgactgggaggagattgtgaatacctttgagatttcaaagcctgggattactccaagtcagagacagcagaggctaagtgct

SEQ ID NO: 946 - DNA, 2095 bp, Homo sapiens
gagacggagtctcgctctttcgcccaggcaggagtgcagtggcgctatcttggctcactgcaagctccacctcccgggttcacaccattctcctgcctcagcctcccgagtagctgggactacaggtgcccaccaccgtgcccggctaattttttgtatttttagtagagacgggagaattgcttgaacctgagaggtggaggctgcagtgagccgagattgcaccactgcattccagcctgggcgacagagcgagactctgtctcaaataaaagtggagttacttttgtgcagagtttccactcccctggtaagaacaaaatacttgtgtgtatgagacacaaatatcaattctgtaatttctaatttcacataagaggtaaaggctcttatgtttgtatttaaaatgatcattacaccaggcctggtggctcacacctgtaatcccagcaccttgggaggctgaggcaggttggatcacttgaggtcaggagttcgagaccatcctggccaacatggtgaaaccctgtctctactaaaaatacaaaaattagctgggcttggtggcgcacgcctgtaatcccagctactcaggaggctgaggcaggagaagctcttgaaactgggaggcggaagttgcagtgagctgaaatcacacccctgcactccagcccgggcaacaagagcgaaactctgtctcaaaaaaataaaatgatcattacacaatatgaaaatgaataataaaattcatgctaacaattttactttacttagaatggcattaagtagcaaaatttaaaaccacgaccagttgagaaattgttaaaggatggaaaaagctttatagttagtacctttaacctaatttttccttttaatttttttttctttttttgagacagggtcttgctctgtcaccctggctggattgcagtggtgtgatcacagctcactgcagcctcagcctcctgggctcaagtgatactcccaccttagcctccctagtagctgggactacaggtgcacactactccacccagctaattttcaaatattttgtagagacagcgtcttgctatgttgcttagggtggtctcaaactcctgggctcaagcagtcctcctgccttggcctcccaaagtgctgcgattacaggcatgaaccaccgcacccggcccaaggagtttgccttttcattttgcactgggccctggatattacatagctgaccttgtcttcaggactaggaaaaggaccgatagaatcctgtgttccttttgaattaatctacatttctttgacaacaagctggacataggcttcatgaagtacagggggctccaggaatactttgttctgaaatccaagaatcctcactgtatcctttacccaagctctggcatatgtcatcatgactttggttcccttggggcaaagagcatacttttggcctgaatggacattgagtgtgggggtgcttaacacctctgaacaggtcttgtccacttttgagttggagggcaggtcagctaggtgtgcacttccaaaagagccctcactgtccaaggtgcagttgtaatccaggaaggaaatgaggtccatgatgtgccactatgtggagaactcacaggttatcacaacactgaaactcttgatgaatgattactggaggagggagtttacatcgtgtcaggccctacactatggagtgtagggatgccacccttggttcccattgtccaaaaacaaaacccaggaacttccacatcttactgtccttcacattggtgtggaaggctttgaagaatctgctgtcctgatgagcgccttgtctcaccacaaaaggctacaacagggatatggcatcaattggatcctcatccagcttgaaataaaccgtggaagctgcttttcctcaggacccgatagagggtgaagttctgggcttggtagagactgaagcagactggcacatcagtggtcacgactgcagtcaaagtgggagacacgatggtaaggaagatgccagaaccacctgctatttctcctagctctatcatacatgcccacatggcactcaagtatcctggtagca

SEQ ID NO: 947 - DNA, 1261 bp, Homo sapiens
tgcaaacgcagtctcctttgcctggaatgctcttcccatgtgtgtcctttccagctcaagtgtcatctgaaggcaggcttccgataaaatacttaactgacaaattaataatctaaagtgaaaagaaatagataaatatttataaaaattaggctctcagatcaaacaggtcaaaatcttgagctcagagcaataacgtaaggtatctgtccagcataaaaattttactttttggctacactgaggccaaaaggaaaaagctgagaaaaagagaaaaataaactgctcaaattcttccctgcccacatttgttaatgaagtaaaccagatcagcaaatagatttgttacttgttcaaggctacctggagatttcatttttcttatacaattcagccaatcctagataaaatgtaaatattgaaattttaaccttgaactcacttgaagctaaaaaaaaataagatgaaggaagtttttcaaaatcaaactgacatggaaactgctttacccaaaattttgatcttcagccttcattcaattacctatcagggcaaataaagtttagcaatgtgaacaaatctcaattttgttagaaatataatttggatctcactttcttttatacaccagtgagttggccgggcatggtggctcgcgcctgtaatcccaggactttgggaggctgagctggctggatcacctgaggtcaggagtttgagaccagcctgccaacatggtgaaaccccagctctactaaaaatacaaaacttagctgggcatggtgatgtgcatctgtaatcccagctactccagaggctgaggcaagagaatcacttgaacccgggagacggaggttgcagtaagctgagattgtgccactgcactccagcctaggcaacagagcgagactccatctcaaaaacaaaaacaaaaacaaaaacaaacaaaaaaaacaatgagttgttatactatctcatgactctaatactaaaatgaaagctatatgatttttatttgagtgtgtatatgtgtttagatgtgttacggatatgtacatttatcatgttgtatgctgtgtttacatagtaaaatctgatgtcgttggtcagaaatcctctaaggataaatgagtactcatataaaatataatatgtatatagccattagcccagataccttttagttcacatgactaaagtaaacctttagtaaataaactggtttttaaattactgataacataaaaataaaaatgtcttc

SEQ ID NO: 948 - DNA, 3902 bp, Homo sapiens
gggagatcttgcctggaggtggtggaaatgcgagtggagagggttcaaggcttcctgcagagaaaggtgtgcaaatcctggcggcgggagaggggctgttaacagacctcagtttttacttcattctttaatctctcctctactcgtataagtgatatacctgtgctttgtttgaactttacggcagccctataagggaggcattgtaagagacctctttttttgtctatttgctcagtgctctctgctgtcagtgggctgtgctcagccctctgccagcattaaatttcctccttaaaacaaccctgagtgtaataggctgaataacggcccccaataatatcagaccctaatccctgcaacctctaaatgtaactttatatggaaacagcgtctttgcaggttaagttaaggattttgagatgaagattatcctggattcgaaagacgaacactaaatggaatcacagtatcctcatcaaatcataaaagggaggttgagagagacgatttagccacggtggcagagattggagtatggcagccacaacccaaggatgccagcagccaccagaaacaaagagacaagcacacactgggggtgagggggtggaggagcggggagcatcaagaatagctaatagatgctgggcttaatacttaggtgatgggatgatctgggcagcaaaccaccatggcatacatttacctatgtaacaaaccttcacatcctgcacatgtatccctgaaataaacagagacaaggacagattcacgcccagcccatggggcagccctataatgcatgctgatttgggcccagtgaaactgattttgggtttctggcctccagaactgtgagagcataaatttatggtttaagtcagcaagttcgtggtaatttgtttcagcagccaagggaaactaatacatcaagataggtaccattatccctgttttacaggtaatgaaactaaggcacaaactggcagttccagggggagccttgccctaatcctttctactgtacagtgagtgagggcttcttccaaagtccttcacatgaggggagaaaagctgagccagatgtaagccaccctaactattaatcaagcagtttttcactatacagtattagctcccctccatgggaaggcagtcccttcccagtgaccaacataacagattggcaacaccccataaatggcaaacatccccaatgcaaaatacagctttccacctaaaattggtgctttctgctcaattaataagcaaaggactagtgccaggcatgatggctcacacttgtaataccaacactttgggaggctgaagtgggcagatcacttgaggtcaagagttggaaaccagcctggccaacatgataaaaccccatctctactaaaattacaaaaattagctgggtgtggtggtgggcacttgtaatcccagctactggggaggctgaggactgagaatcactttaacccaggaggcagaggttgcagtgagccaagatcacgccactgcactccagcctgggtgacagagcaagactctgtcttaaaagcaataacaacaacaacaacaaaatagtaataataaataaccaaaggacttcctgctgacctgctctgctttgggcactccaaagtgttctgtggcctctgaacctcagtttcctcatccataaaatagggataataatatacaccttaaagaattattgtgtcccatatctgtaattccagcactttgggaggccgaggtgggaggattacttgagcccaggatttcaaaaccagcgtgggcaacagagttggaccccatctctaaacaaaaagaaaaattagccaggcatggcggcaacacacctatgatcccatctacgcggatcacttgagcccgggaggttgaggctgtggtgagctgtgatcgcgccacagcactccagcctgggtgacaaagtgagaccttgtcttaaaaactaaaaaagaattattgtaagaatttgaaataatactcataaataactagtatagttcttatcatgtcagaggtcctggaaatggggcaactgtcattttttttaatcctcctagttagttttctgctagtctcagaccaccaaggggcattttgttcccatctctcacatcccccaactgacctatcctactttttatcattgcacatgttacaggtactctgtcccttctctgtgagaagctaaactgttagaagattctaatggaaaagaggaaactaggccactagggctcatcacaaatggcattagctaactgaaaggaaaggtacatggaaaatgatgagatcgtatatcacaaaatgtaggtacatgcttctttcatctaactttggggccagactgaaagcaggaatgaggtggcagcatttcctaggaaggaaagacgagctggacaaaaggcatggaaaaactctcagctcagcagaaattaaggagatgcaaataaaaattataaggacatacatgtttatacctaggagactgctagaagtcttaaagtctgaaaaaaatcagatcttggcaagaatttgggagtataaattgatataacctctttggaaaatatggccttacctagaaaaatggggcatgtccatatcctactacccagcaattgcactgctaggaatattcccccagagaaactcttacccatgtgcaccagaagactcaaataagaattttcatggttacattgttcattataacagaaatctaggaacaacccaatgtttgtcagtactagaatgggtagacagttatgataaatgtatacagtgaaacaccatacagttatgtaaacaaatgaactacacctgcatgtatcaacttggataaatcttacgttgtaattttgagggaaaaatgtaaatcacagaagaatatgtatccttgatgccattaatataaacactaaaaaccaggctaacctaaagagtatattgttaggcatacataaatagaatggtaagcctgtagtaaaagcagaggatgacaaacacaaaatatgagaccagtgagttctgagtgagttggcagggctgcagcctggagtgttggaatacctgtattactcagagtcctccagataaataaataggaaacaagtagacagatatttattataaagtattgtctcacatcattatggaaactgagaagtcccacaatctaccatctgcaagctggagacccatgaaaatgagtgaagtagtttgaagccctgagagctgaagaggtggtggtacagatgctgtctcaaggcctgaaagcagggagaactgagagcagggaaagatctatggcccagctcaagtattcagacagagagtgaatgcagccttcctccccctttttattctcttcaggcccaccatggattggataatacctacccacattggggagggccatttgctttactcagtctatccattcaaatgctaatcttggctgggtgtggtggctcacgcctgtaatcctagcactttgggagactgaggcaggcagatcacttgaggtcagaagtttgagaccaacctggctaacatagcaaaaccccgtctctactaaaaatacaaaaattagctgggcatggtggtgcacgcctgtagtcccagcttgggaggctgaggtagaggaattgcttgaacccaggaggcggaggttgcagtgagccaaggttgcaccactgcactccagcctgggcaacagagcaagactccatctcaaaaaaataaaaacaaatgctaatctcttccaggaatgccctcacacacccagacataatgtttaaccagctacctgggtacccattagcccagtcaagttggtacataaaattaaccaacac

SEQ ID NO: 949 - DNA, 2513 bp, Homo sapiens
acaccggcgtgctcgcaagaggcgggaaagcgttagggagagacgcgggtcgcagggtccctccctctgcctgccctatctacccgcctgcccagcgagcctgtccatcttcagcgcccaggccctaggggaggggacgagaaaggccccgcgcttctgactcatcatctccaacccctttctcgcgcgcgctccaagtctcaggacttcggacctgggccctcctgcgagggggtgcggcgacagcatctgggaagccccagctctgccaagcgtcagctccgagccctcgccagtctctgaagctgccagcgcagggctggggacccagatccagctctctattgcagtggctgggggagcggcacgccagtgcaggaccgcccgcccggctcctccccgaacgcggggccagtggtcgcgtccgagaaagcgccaggctaggccccgacttccccgcctcgcgtcactcagcacatccaacagcgcccctaccgcggagagaaggctctttatttcctagccggtcacgggctagcggggcatcctgggacttgtagtctccgctacagtagaaaggagatggatcgaaaggggaactggggcactcctgaattggattcagggagttggcgtgtgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagaggtgagaaaggagaaaccccagacagaaacaactgcttcctcctgcccaattttctatcctgtttcccatagtcctgccaatatttaggcagcttcctaatgctttcccactcttttaacctcaatcatttggattcccagtttcctcttacccaccattaggggagaaatgttcaaagccagagaaagccaatcagtttcattctaggacctcttcttttctctcctgccccattattttcccttaagtgccactgaccaggataggcagtggaaaaattagttggcagctagctattcgtgctttcttccctgcccccatacctcctgcagctcttgatagtgcagactctggctcctgcagcatcctggtttcctctggctcagcaagaatagggcgtgcactgagaccagcactccccctagggtgaaggcctcagcactgagttccagcaccagcaagccagcatgctgcaggtagacagggctgagaatgcagggaccccgcacctgtttgcccctgcccttttcccttcccacctcctcttgcctccttatcctcccaccttctccttcattgaccagtacctgggaggaggcagttggggcaggccccaaggctgtcttcatcacctcgaccaccaccactatgaaacccaagatcaagttgaaggtgttgaatatcatcatggcccgcacctgccagtgagccagctcagccctgcccagcctaggggagtcattccaacctcaatccccacttgcagcctagctgaagacaaaactcagcttctgcttctcagcctccaaacagggccataagccctcttaacttttttgctttcctcctcagtgattgaggccagtcagtggtgacagctgagagaatgagtcaacacttagccacttacttcctaggctgagggttgtaggtgtctgttttagggagtgggaggacagtgctgcgttttcttccctctcaccttccaaaggcggggtgctctgcgaagctccagagtgacagtcccagtgaggagaccctgaatggtgagaagggcaagtgttgagctctggtcccgttaggaaggggccctgggaccttccaccctcccttgtggtgggtcttactgaggctccaggcccaagaggcagcgctgtggccatgtgacaatcagagttcaggcaggcgactgagacagcaaggggcaccacaaccactgccagccatagctggctcacctgggggtaagggtagggtaattggggaggaactgtcagggattccctcccttctcgtaactcctacctctttagagatcaggaaatgggattgaatgcagggtggaggaaagcagtcaacccagagcaaggacgtgatcattaaaaattaagtatcattt

SEQ ID NO: 950 - DNA, 2451 bp, Homo sapiens
aagctttcagaaattggattgcatttcttgcttattatacatcccttgactattttgtaattgtgtgtatttgtggaggtcacatgtaaataaacttaaagtgactctactttgtgaaaatgtgaaacttcgtgtaggtactcagtaaatcagtaaattcttactaacgttagcccccagcctagctatggagggtgcatgctgagcccgaagcagagagctctgtaatctctgcattcatcaccaccatgaggaggcctcagaagcttctagcactgtttgcaccttccccacatcacccctccctgccttcctcacagtcttccttctgatcagaagaccctttccttctttctctgcctgtcaaaatgctgctcactcttcaaaccctagctcatatgaaagtgtctggtgtgagcccacttttattgagttgattctgtatctttgatacaactgtatgagggttctccagagacacaacaaatagaagggagacgtaagaaattggtttaaaggttcaattgctaatctcatccaaaaacacccttacagacacgcccagaaataatgcttaaccatgtatctgagcacctcatgatgccgtcaagttgacaaacaaaattaaccatcgcagcagccatacatttaaatatatttgtaccagagaacttacctgattctacctgcacttcagatgcttaagacatgtctgttttctccactttccccaaccagattgtatatctccatgaataacctaaatgatcccccaaattggaatatccggcctaattccagggcggatggtggtgatggaagcaggtggaattatgccctgttggttccaatgctgggattggctgcttttcgtaagtcatggttttcttaaaattagtgttttccaggctgagagtgtggagccccggtgagggaggcagcatggtgtgggagcctgaaggccgtgactttgggacctgccagggacagccgagttttatcccctgcagtgaaccgtgggcaaatcacttaagctctgagcctcagtcttcctgttcacaggagatggataatcatacttaacctcagcacactgcaaggattaagtcagccaaggcgtttagaagcattttgtgtggggtgggttttaataacttagttccctctgaaggctttgctgctctcaagtcggggaggaggttccttatttcaggtgccctcataaggactgctggggaacaaaacgggtgtaaaggaaaccagtgggctgggcgtggtggctcatacctgtaaccccagcactctgcgagacccaggtgggcagatcgagtgaccagcctgagcaacacagcaaaaccccgtctctacaaaaaatacaaaaattagcgagtcgtggcggtgcacacctgtagtcccagctactcaggaggctgaggtgggaagatcagtggagcctgggaggtcgaggctgcagtgagtggagatggcaccacttgccctccagcctgagaaacagggttaaaaaaaaaaaaagaaaaccagttttggaaaaccagtgatgtttaatgtttaggaaatcagtctttgggagacttcatccatgaaatctctgcttggcctggccagaaattctctctagtttagattgacttggcaccactttggggaactgtcagtcacatgcagacttacatccccaccacacaatcaattcactgatgcagaggagtgagttttgtgtttcttcacattccatggttctgggctggcacttaggaacatgagaaactgaataattgaatggaagaaaggcaagactgccctctagttgtagcgatacattttgtgtagcggctttttatctgcttcgatgtctcaggtcagaagttttgctgtagaggaagaggaggctggtaagagcaggtggtttttatgattcagtgatctgcgcagtgcttgcttcttggtgaaagacagggcaggtccacatccaatcctaaggggctgccatgtaaaaagctcatccgcctgcaggcttgggaaaaaaacccttaacacttggagaggctactgttgcctgtggctagggtgagtggattggaaggcttaaaattactctgactaatgtaataattaattggctttgaggctgggagaggccctgaagtgactcattttccatttgtttttcagactcatctcaagcttttatagcctttcatgataactttcacttctgaaattcttaccttcccttcttggacttttgaaatgatgctttctgtccctgaaaagggttgaagaatattttttcttcctggttttttgctgaggtagtgtggtcagagataactgttaacttggtgttcttgtaaggattctccaaaggtgtgttacgatgtgtttgaggttctattgcacataagagcgtaaccagccttcagtgtagtc

SEQ ID NO: 951 - DNA, 1564 bp, Homo sapiens
gtggactcaaaggttttctccctgagaggcagagcccaggccagctgattcatcagtatcaggatggacatggtagaggatgcggatactttgcaggagtgaggggacatcattatgaagcatgagaaggtagagggcagtctgctccctggagggaggcctcctccagtgcaccctggtgaaagggtcctgggctccctaggagcacagagcggggacaggtggccctttcaccctttaccttggacccctcaccaaggctcccactgggttgcagggacaccaagctgggctgccagcagacatggggcctgtgcctgttggaatctacagcagtgctgattgctttgggattctgcatgagacggagctgccccctgtcactacctggaaggtgaagcaaatgtggcaggagatgagatgaaagagcaagtggatggaaatgctgggagaatgggagacatatcagaacagcaaaaaagtcatgaaggagaagggcaagaggtcctctggacacatccaccagatcgacctggacatgagccggacattaaggaaccacctgttcttcagggaccgatatggagtcaagtaagcctatgggagccacagggtcccagtggagatggggtgaaccagagggatggggacttccctggagcagaagccaggatcacccaggagggatgacagagctgccaagagctctcctgtaccagggagcagctggtaccatggaccgagcacctcccaagttccaagccctgggccagactggaacacgtggggccagaacccaggaggatcctgaggagacagacggcggcaaagaaaatcatgcacaatggtgaaaagtgctctccctgacccacagggacccatggtaggacccacgggagggcagcaggatggagggcccatgagcttccccaggcaacactgacaggaccaaaagcagggggagcttggggtcctggaaactctcatccaggtctgctgggaacatcacacggcacagccactttggcagccagttgtgcagtggctcacaaagttcaatggacttgaaccacatgtccccaaagtgtcaccgatattgaacccactgatttgaaaactgatgtccacatgaaacctgcatgccacattcactgcttgattcattgacactcacacatggaggctacgggaatgaccttcaacacgggaacgcagagaggaagggtggtcctcccttcaaatggcagaagattcagagagaaaagggaacgatctagtgatgcccacatgaacatgggtggatcctagatgcgttttgctaagggaaagaagccaggcccaataagctaccacagtaggattcccattcctagaccattctggaaaaggccaaaccatagggaccgagaactggtctgggtggccagatgctgacggatcagggagaggctggctgcataggggccaccctggagacttggaggatgaaggagtcactccaggaggggctggagcagtggccaggagattctgcacatcggtttagaaccctccttgccctgca

SEQ ID NO: 952 - DNA, 16406 bp, Homo sapiens
attcagaagctgctatttctactgttggttaatgtatttttgtttctaccaaggaagctgtgaaatccgcgtgcacacccatcccaaatctatccgtggggcgggcgcaggctgagtcattcctaggagtaactttataccgatcctcgcactctggggtcgggacaaagacatcatctctccgttcctcccattcggtgagcttcgttcggcctcggccaaactccactctcccgtttctcgagtccaacacagaattaagggctgatccctggcagcgatgagcacaagtcaagatgcgtcttgggaggttcggacgtccctcgccctcggccactccggcaactaggccgggtactaagcggcagcgcagagggagggatcccaaggctccggccgaggaagccgcaggcagccccgcagcacgagtccgacccacacctccggcagcctagtggagcatcgactcgaaccgcttttgtctccacaggggctgtcgcgccgggaaagcggccagtgggcaacacctgccggggcgggaggcgccggggccctcccgtgcacacacctgcgcgtgggccgggctcaggccgaccggaaccctggaccatgcgaccccggcccaccgtgccagggcccgccgcgcgaccgctgtgccagatgggggaaggggacgcgggcggcggcgacacttacccggcaacgcctcctccttcgccggcggcagcagcagagccagcgacccccggcaccatcttccgccgccgcctagtcctcggcagcggttaccaaccgcccattcggcaccgctaagccgacacaaccgccggcgtcccgggcgcccgcccgccgcggccccgaactctaggaggcagggaggggtccgggcggacaaggacgcgagcaggcccctcggctctgggtctggggccgggggacagaaggccgcggcctgtcagagccgaggggcccaggcgactgggggattctgaggcaacgccgagggctcggcagggccgcggacaccgccgcggcttggtttgttattgtcgactccgtctcttcctccgcggcgcatgccgggaaacggcctgccgggggaggggcgcgcctggaggcgcagagaggcgtctacgcaggtccggaagtcggcagcctgccgggaagggggcggccccgcctccggctctccggccggcaggttggctgtcctggcctgaccctgggagactccgctggggccgcctgttatggtgctagctgccgtcccggtgcgtactttcccaaggtgaatttgaccttctttgcgacagctaggccctgactaaggtcgacccaccaaacactggatcgtccccaggcgaaagagagcttgttcccctcagcctgtcgcggaggagcggagccaatcgagggtctggtgtccccgtcgcctctccaggggcaacctgcggactaggccaaggtctgtaacaggataacgtaccagcgcctggcccaggcgttcctgccgccacctccccgcatatccggaccgccgggactgcacgcagctggcaagcgtccccctgttaactctgcaagggtggggcggcaccatttctcagaccaggtaaggcaagaaaacatgcaagagagaagagagggaagcctaggccaatcggaatgaaaatgtaaacgccacaaccacgttttcagctttacaaatactgaatcttgtagtgggtctagtgggttaggggttagcatgagcaccctaatggttgggagacagtttcaggggactcttgcatttgtgaagatgatcagtcacaggcaatgacttgaagccacgaggcttgaatattaaaatctgatgagcagatgttacacgtagaataattacataatagttctcaaattcctgttatatccaggaatatctggtatgagtgaaaacttggaggtgccttctctaaagtcatcaggaattctgagttgtgtttgtaaaaataggaggcacaagagggcaccaaactgaacaaaatgttaggtggaaactgaaaaacgttggttagcatgaacaatttcagttttcagtcacactgaccagtatctgtaagttaggattgagatgggcttgttttatttatttacttttaaatttgtgctgctacatatcccaaacaaatgtggtctttatcatcactggcaagccattttacttattggttaagctggaattttattacaccaccccagcaagatagaggagaaaagcgaaaattaagtagtaaatggttattatgccttaagggaaggtgtgaactggcaagacaaaagagccaaatttagtagtaaagcatagtcatcagcacacagaaaataagtggtgaggaggagtttggccagaaaattggctaagaaaaatggcagtatgaccaagaatgaaaagaaaaagaaagaaaagaaaaactgcagtatgaggcctgtaaagaacgtattggtacttgcacttcctcttattagtgacattcattattacaaatataacccaatttagaatgtaaaaatcttgctggagctcggtgcagtggctcacacctggaatcccagcacttatgggaggccgaggcaggaggattgcttgagcccaggagttggagaccagcctgggcaacgtagtgaaaccccttctctacaaaaaatacaaaaattagctgggcgtggtgatgcacacctgtggtcccagttactcagaaggctgaggtgggagaatcagttgagcccaggaggtcgaggctgcagtgaaccatcatggcaccactgcactcctagcctggacaacagattgttgccctgtctgaaaaataaaaaaaaatttctgaactatgccagtgataatctggtaaattataaatgttgtctgacttttttctttggaaaatgaattaattcagtcctaaccttctctcttaatcacaggttgcaataaattaccagaaacgactggttcataccttatacacctccagtgtaaatgttaagagtttgtatattcttaacagactcttaacaaacatcagtaattctttcctagggataagtgaaaatgtactaacattaattctattatatatatgcaaatatctagaggaaatactgtttataagttactaatacatgtatccatggtagtaggtcttgaaaagttacttttgttgcctattggacaccctctattctcccttccttaataaaacaaaaaaaagaacaaacaaaattctgtagcatcacttctcaaccaagctttctgataggaagtcctcagtccaatctcatttttggcctactgtgcatttcttacttaacttgcaaacagatcattaacaaggacctccaaattacagtaaattacagtactaagattttacttgaactttctaaagcattcgccattttaaattatttaacttttatactcctccttcccttttgtgctgtttccttcctggcgctcctaaatatctgtccattctttggacctcttccaaattttcagataattataatagtgtgcgaatgatgcaaaggtaatgtgccgtgggagagaacagaagagagaaacctaattctggcctcatcacattattgtttttttaaatttaataactattttagatgcttcagtagatttacagtgagggcaaaagaaaacagttttctttaggagtatggagggattatataggatgtacaataaataccctaagtacttcaaatcagttcagatctttaaaatcctatttttccttcagttctcaacttcaatatcacctactctgggagtcattccctaccatgcttgtttgtttgtttgtttgtttgtttgtttacagagtctcactctgttgcccaagctggagtgcagtgacaccatctctgctcaccgcagcctcccaggttcaaacgattctcttgtctcagcctccctagtaactgggattacaggcacttgccaccactcccggctacttttcatacttttattagatggggtttcaccgtgttggccaggctggtctcgaactcctgatctcaagtgatccacccgcttcagcctcccccacagtgctgggattacaggagtgagccacagcacctggccacatgcttgtaatttctttagattctcacattgtatctttcagtgtcatctaacatgctgactataagctcctttttaaaagatgtactgtacctggtatataatggtatgcactcaacaaacatttgacagtaccccacaacttgttcaggccctcaatttatacctgaattgacctcctatccatctccattatttactccatccaagaccagtctaatcaaatctcttccctgcctaacaactttcattggttttgttttgtatactagatacaatttaaacttttttttttttgagatggagtctctctctgtcacccaggctggagttcagtggcgcgatcttggctcactgcaagctccaccgcctgggttcacaccattcacctgcctcagcctcccaagtagctgggactacaggcgcctaccaccacgcccggctaattttttgtattttttgtagagacggggtttcaccatgttaggcaggatggtctcgatctcctgacctcgtgatccgcccgtcttggcctcccaaagtgctgggattacaggcatgagccactgtgcccggccctgggcatgggtaaacttcttaacctagcatgaaagtctctccatgataaggtatcaacccatctctccagtgtatctcccagcacttttctcccctttatatgtgctctatatgagtttcctcatccaggaatgttcttccccacttgttcacctttaaagtcatcccttaaaacacagcttggatgttagcagcttctaacttctagagtttccactcttctattaagctttgctctgtatctcacaactgtaaatttttctctcccctcttagtctgtgaaactcttaagattaagaactatgcattattaatttttaaattcctggaactttatggagagcttggcagtcagcaattaatacaagatttgctgtatgtaatacattctgcaaatttttatatttatattgatggttgactagaaagttactgtggaaaattcctgccatcaaatatctcataggcttgtaaaggggaccattcaaaacaattgcagtaacaaaggcagggtgcagtggctcacgcctgtaataccagctgaggtgggcagattgcttgagctcaggaatttgagaccagcctggacaacatggtgaaaccctgtctctagtaaaaatacaaaaattagccaggcatggtggcgcccaactgtagtcccagatactcaggagactaatgtgggagaatcaattgaacctggggacggaggttgccatgagccaagatcatgccactgcactccagcctgggagacagaatgagactccatctcaaaaaagaagaataataataattgcaggctgggtgcagtggctcacgcctcatgcctgtaatcccaacactttgggaggctgaggcgggtggatcacctgaggtcaggagttcgagaccagcctgaccaacatggagaaaccccgtctctactaaaaatacaacattagccagtggcgcatgcctgtaatcccagatactcagtaggctgagacaggagaatcacttgaacccaggaggcggaggtcgcagtgagccgagatcgcaccattgcattccagcctgggcaacaagagcgaaactccgtctcaaaaaaagaaaaaaaaaataaatataattgcagtaacaaatttatatgatattaattctttaccaaagtacattcagtttattgggaagatcatggtaaacatcttaattttgtcaactctgcctgaggcattcagcacatgtattaaatatttctcaaacaacttagtgtcattaccctaattttcttttaggcaatgttcaaacaaccagcaaccacaattcacataatttggctttattcaaagtatgaggcacaattattgttcatttttaaaagggttaaaaagatgtacgttttggactttgtttttaaaaccataactaatttggtgtatatgattatgtactatttagaggctgctggcactatgatgattaagttaatgttttcagtactgcttatagacctgaaagctgcccttctcagctggtttgtgggtactcaaacatactaataatgatgatggctaacttaggaatgaccatcttcaaagctagtgatgacttgatgagctcataagcaacactgtttccaatgctgcagcaacatagtcaagaaaacacttctagaatgcttaatttcctgaaagatttaaaccaatagattaagacaaaacatttgtagtcatttttcagattgaaagagatatctttttgcatcatgttttattaggttcttgtctttcattattttgaagagctgcctagcaaagtgtccaaaaatagagctggcactgtttataaaatgccttaaggcagaagttaatcagtcatgtagacacagatacagaactgattcaaatgtcaagtggtagttggacttcaggtggtgactttctaacttttactgtgatccacattaagaaatacagtttcacattgtgacctggtatacatacacaggaaaaagtacttgctgcttgtgatatactctgataccttctattgtttttttttcctcttgctagtcttacacattacatcgattttactatcatccaatggtttcagagatattagattcaatgacttaggccccaaaccttgagattctttgttcctgatttttctgtcagtgccttcctatttctgtcagtgcctcagtagtgtttataaataaatgcttctttttttttttttttgagatgggagtttcactctcgttgcggaggctggagtgcaatggcgcaatctcagctcactgcaacctctgcctcccgggttcaagtgattttcctgcctcagcctcccgagtagctgggattacaggcatgcaccaccacacctggctaattttgtatttttagtagagacggggtttctccatgttggtcaggctggtctcgaactcctgacctcaggtgatctgccctccttggcctcccaaagtgctgggattacaggcgtgagccaccgcggctggtcaataaatgtattttttaaaaagcatgacctaacggagctcatgaaacacttatgggtgtatcttagatgccagacatgggttttaaatttatcaacctgtttagttgtcttagcagccctatgcagtttctgtaaattttctttgattttacagatggggcaataaggcatggagtggttaagttgctaattcaatgtacttccttctagttagtgttcttaaattagtaactgtcaaggccaggatttgaacccaggtaatccaattgtacgggctatatcctatatatcctatgcatagcctatgctcccccttaatttggtgctggtcctgcaggggttaaaaaaaattggctcagcaaggtggctcccagcttacaccagtaatcccagcacttggggaggccaaggcaggtggatagccctgagttcagaagttctagacctgcctggacaatgtggcaaaaccccatctctaccaagaatacaaaaaaaaaaaaaaattagccaggcatgtggtggcatacgcctgtagttccagccacttgggaagctgaggtgggaagattgcttgagcctgggaggcagaggttgcagtgagctaagattgcactgctgcattccagcctgggcaacagggtgagaccctgtctcaaaaacaaaaaaagaaaaaatgtctagcaataggttacagagtttctcaatctcatacctaccagttaattctttgttataaggggctgtcctgtacattttaggatgttgaacctccttggcttctgcccactagatgccagtagcaccccagttatgacaatcaaaaatgcctctggacattttgtaatgttcccagagggacaaaatcaacccctttctcagaattcagggaaaacgtggtacatctatataatgaaatactatgcagccattaatattatattttagaagaatatttaaaacaggcctggcatggtggctcacacctgtaatctcagcactctggtaggctgaggtaggagaatcacttgaggccaggagtttgagaccagcttggacaacatagcgaaaccctgtctctacaaaaataaaagtaaaaatatagaccaggcgcggtggctcacgcctgtaatcccagcactttgggaggccgaggcgggtggatcacgaggtcaggagatcgagaccatcctggctaacatggtgaaaccctgtctctactaaaagtacaaaaataagttagccgggcgtgctcgggaggctgaggcaggaggatggcgtgaacctaggaggcggagcttgcagtgagccgagatcgcaccactgcactccagcctgggcgacagagagaataaaaaaaataaaaataaaaataaaataaaaatatagctctgtgtggtggtgcactcctctagtctcagctacttgggaggctgaggtgggaggattgctcgagccaaggagtttaaagctacagtgaaccatgaccacaccactgtactccatcctgggcaacaaagtgagaccctattctaaaaaaattgtaaaaatatgtatattaattttttttttgttttgagatagggtctcactctctcacccaggctgtaatgcattggcacacccacggcttgttgcagcctcaacctcccaggctcaagcaatccttccacctcactgtccctaatagctgtaactacagatgcccaccaccatgcctggcaaatttttgtattttttgtagagacagggtttcaccatgttgcccaggctggtctcaaactcctgggttcaggctctcctttcaccttagcctcccaaagtgttgggattacaggcgtgaaccactctgcccaaccaaaaaatatttaaagacaaaggaaaacaaagtagcaagctactctgttttactatgtttcgtattttaacatctctgaaatctgggtccatttaacagtggatggatagtggtcctccaagcttgtcaaccaatgccatccatttcctgtgcttactataagacatcaaaaacaccagattggaaaaaaatccaaactataatggtgagagaattgatgaataagatgtgttgtacaacattcccaaagacagctaggtacctagcaccacagctttagttcttttatggattctgtaaggaaatgcttgttgccagtgctttcagtgctgcaaaggataaattctgtggaaaaacccagacaatctctgagtcggaagtaatagttcaaaagtgatgaaattttagaaatacctttaccaatgtaatttgcttgtattttcatttttatgtatgggcaatataataaaaatgtgtctaatgaagtctaagaaagctttctaagtaagtacaaaattaaattctaagtgatttttcctatgtgtatatttttcttcattttccagactacatatttttgaaaaatgtaccattagtcttttgtaacttaaaacgagttctgttgtttatcatataaaatgaatgcttttttcccaattctctgaagtccatttattttaataacaccatttgtttttttgccttcttcctcaaatgatccctttgttttaatcaaccctacctgctatccattcatgcaaaatacttttcccaatagtcattccttttcagtatgatgtattaaaaggaccactgaactgaatgtctggaaacgtgggttccaattctacctcagccttctgtgttgtttccctagtagttcactcttcctactctccatcagattgtctgcactattcttgaatccctaattcccaccccttcccagttctctctttggtaaataatctcacctcctacaacactgaggaaatagaagccatgagaaaagaacttcctcttctgccctgaaatctgcaaacctatttgcatccacaaattctctccaacagtcactattctgtcccttctatttaaggtagtcgtgggtttttgactccatctcattttaccatctcattctgtcattctgtggaaccacttactaagtacaaaatttagttcatgtgtgacataccttacaaaacttaaatatctttaaaattgaaatttatccggtttcattgtttattcatttaaaattaaaaatcaagaagtaaaacactctatcatcaatatgatttagtagaaacaaattatatcttgtagatgttattgaaattcacttattagttgctggacaattgtttacataaaatgactttttaacaaagggtcaaagttaaaactcctaggcagatctcaaaactatcaagtagtatagattttttctttttggttttgtaatatttgtgtggcttttttttttttaacttttaaattttgactgccttgattaaagtttcagttaaaaaattttgctgtcaatttcttttctaaccattactattattgttgttctattgttactgaaactatagaggaatgggatgttaaaaaattatctactctgagtgtcaaatacacttcaccactggcagggctcagggctcttcattttttaataagttctagggggaattctaatacaaggaatggctttgagaaacaagactaaatttttaaaaatcctcacagtcctgctcaatcttctttctgtcaatagatgtcgcccctcccttgaaataagctcctcagaaaaatcctaatctacacacaaagctttctatgtgtttgtatgcttattatggattaatttgaactcatataattctcagatgtgccttaatttttaaaatatgtgtatatagtttatacacatacatcataagttggctgcattaaggagttggaaaatctgggacttcatttggatttggaaaatcagttaacatctataaattcaagttcctcattttgaaactgtgttggcaatatctactttagctacctcacattgttctataggttagaatgaaaaatcgcatgtaaaatatactgtagctctgacatttgtacggtccctacagaaattttacattagccaatcaacactttttgaaaaatctaactccagtggtttttaaaatgtatgaagtgcttgtattttagtacaaacatctagttacatttaaaacattttgtgaaaagaattgccataaaatatttttaaagttcacatctttcttaccgtttacattcatgttataggctttttgtctcctctcctttcatttttttctactcccagagttctggaagctgaccaaagagatacttgtgtgaaatgcttgtattttccctaccatatttaaggctctcaagagcaattttatgctcctgttttaagattttttttaaaaaaaattcaatatcaccaagaaatgaactgaaaatgacaggttttctggaagaaggttcagctaggctttattaagaagttaggaggccaggtgtggtggctcacgcctgtaatccaagtactctgggaggccaagacgggtggatcacaaagtcaggagatcaagaccctcctggccaacatggtgaaaccccatctctactaaaaatacaaaaattagttgggcgtggtggtgcatgcctgtaatctcagctacttgggaggctgaggcagaattgcttgaaccagggaatcggatgttgcagtgagccaagattgtgccactgtgctccagcctgggtgacagagcgagactccgtctcaaaaaaaaaaaaaaaaaaaaaaaagttatgatatgtcctcaacacagtgggtagtacagattcaaaataagtaaaaatgttaaagtccacattaagtgactttaaaaaattatctttttcctatttcatataactgcttcagaagtattgtttttacttgaaaatattttgttgtatttctgtacaatagcaataaacaattaaaatgcaattgagaggccaggcgcagtggttcatgcctgtaatcccaacactttgggaggccaaggcaagcagatcacttgaggtcaggagttcaagaccagcctggccaacatggtgaaaccctgtctctaccaaaaatacaaaaattagctggatgtggtggcaggcatctgtaatctcagctactcgggaggctgaggcataagaatcacttgaacccgggaggcggagtttgcagtgagccaagattgcaccattgcactccagcctgggcaacacagtgagactccatctcaaaaaaaaaaaaaaaaatctgtgaaacattctcttcccaatttcaaaacttttctacaaagtcacagtaatcaagatagtgtagtactggcataagatcagacagatcgaatagaattgaaagtccagaaatgaactaagtttaaagtcaattgatttttctcctgaatcaaggactagcaaaaaataataataataaaataggccaggctctgtagcacaggcctgtaatcctagcactctgggaggctgaggcaggaggatcgcttgaggccaggagttcaacaccagcctgggcaacatagtgatactgtctctactaaaaaaaaaaaaaaaaaaaaaaaaaaaaaaaattaaaaattagccaagcatggtggtgtgagcctgcagcccagccacttgggagtctgtggtgggaggattgcttgagctcaggaggtggaggctacagtgagccatgatcatgccactgcacaccagcctggtcgacagagcaagacactcaaaaaacagaaaaggatatttcaaaggaggaaggaagagccttctcaataaatagtgctgggaaaactgaatatccacatgcaaaacaatacagtggcactcataccatagacaaaatgatctcaaactggaccaaagactttaatagctaaaactataaaattcttagaagaaaacaggagtacatctcttcagctttgtattaggcaatggtgtcttagatattacactaaaagcacacttaacacacacacacaattagataaattggaccttatccaaattaaaaacttttgtgcttcaaaagatatcatcaagaaagtgaaaagaggccgggcatggtagctcatgcctgtaatcccagcatttggggaggcatcagtttgagctcaggatttcaagaccagcctgagcatcatggcgagaccccatctctacaaaaattaccctatgtgggggctcacgcctgtggtctcagctactcaggaggctgaggctggagaatcacttgaagccaggaggcggcagggctgcagtgagccaagatcaagccagtgaactccagcctgagtgacagaatctaagaccctgtcgcaaaaaaaaaaaaaaaaaaaagtgaaaagacaaaacatagaatgtgagaaaatatttgcaaatcacataacaaataaggaacaatatataaacaattcttccaactcaacaataaaaagacaacccaactttaaaaatgggctaaagatttgagtagacatttctacaaagatatgcagatagccaataagcacatgaaaagatgttcaacctcattactcactagggaaatgcaatgaaatcacaacaagataccacttcatatccaccagggtagtcaaaattaaaaaggcaatagcaagtgatagtaaggatatggagaaattggaacccttgttagtgggattacaaaatgttgtagccacttcggaaaacagtttggcagttcctcgaaaggttagagagttaactacatcgcgtagcaattccacttctagagaaatgaaaacatacatcacaaaaaaaaacacaaatgttcatacagcattactcataacagctaaaaagtggaagcaatccaagtgttttctaatgttgaatggataaccaaaatgtggtgtatccaacaatagaatattatatgtgatagaagagtttctgttcctcaaataataagcatagaatgactacgtgatccggcacttccactcctaggttatatactcaagataattaaaaacctatgtccacacaaatgttcagagaagcatacttaagtaggcaaaatggaagcaacccagatatcaactgataaatgcacagaccaaatgttgtttatccatacaatggaatataacctggcagtaacaaggagccaagtactgatacttgaaaacatgctaagtgaaagaagtcacaaaaggccacatattgtatctttacctttatatgaaatgtccagaataggcatattcatagacagaaaatagatgagcatttgccaggggttggaggaagaaagagaagaatgggatatgactgctactggacataagatttcttttgaaaatgatgaaaatgttctgaaattagtggtgctagtttcataacttgatgaatatactaaaaaccactgaattgtacactttaaaatgatgactttttggtttgtaaattatatttcaataaagctgttattttagaatatttaattatgtttttaaaaataagataagcatgaaatcaaccaagagaatagccacatacgaacctgtggctagctctggttcatttacgcctcactgaggtggtactccagaagaagaaatctaatggagcaatgaatgatagccaagatggggtggggtgtccgagtggttacccccgggtacagacgataaaggagtacactgtctatacgattgccatttagcaacaataaaaataactagaatcagtctgcttttattatcacctttctgccatcaaatcctaaacaatgtcattgaaaaaataaactctcacctcaaaaacctggttggtccaagccagggtttctcattctgttgtcattttgggccaaataattgttgtgggaggctgtcctgtgcatctttggatgtttagctgcatccctggcctccacccacttgatttcagttgcactccccacaatggtaacagccaaaagtgtctccagacattgccaaatgtcccgaaaggcaaaacagccaaggttgagaaccattgatttaagttctaaataaatgctgtgattgtctattgaattttagtaacgtgtaagcctcaaattagcacattgttattgcttatcttttaattatactctggggaagttaattcaaagaactcttgattatacaactggtccccaacatacaaggactcggctttatatgtgtgttggtattgaaagtacattcttaacagttctaaattgtttcagcttgttttgtgcacagctcttatctccaacctttggcactatagaaatcctagctttaaatagcagattcataatacacgatagcgccgtgattgtaaaggtgtcaaaacaaattgaataacttcagttctgttattgtataatatatacacaccattttctgagacatataggcagagttccctttctcttattttcacatgtctccctgaacctttaatttttttcaaaaaaacacattcatgtaatggaaaagtattaatttgtttccttttttgtactgtattattttatttacatttttatttgaaaaaatttaatgatagttacaaagtaaaaatcaataaaatatttttcagtgtcttctttctggtctgtatttcatttcatgacttaaaaataattttctcctttagaggaggaagtcatttaaaatgatctgtactaggtgtcaaatgtgctaggcacaccactgatttaaggaaagagataaagtacaccacgatgaaagtagaaaagaagaaaaagtgcattaagatgaaaaagaacataaatagatgaggggccaaggaatcgaaggtgagaaagcagaaaattgagagagaccaggaggcaaaattggcgacttctgaaatgagtagattatttaattgcatttgttctgtttttatttccttatcctttgtttgggcggtgggctaaggtctgtacattatcatctgttcttcccacacatttgaaagattagttgccaattaattactatttttaattcttcaactgctctgtagcttcagctgtgccttgccctgatccacgtcgttgcagaggcccaaaaattattctctaggtgctacgaaggaggaaagaatgcccagaatagggagctaacaaaattgaatggatatgtgtgagatattaggctagatgctttacataccttattccatctctcacaacaaactgcc

SEQ ID NO: 953 - DNA, 1112 bp, Homo sapiens
tagcaatagactaagaaacatatttgtttgtacaaatgaatatcagggcacattatggttagaaactttaccccaagatgtaaagaagtgattcttgagacatttggtctcattgagcaaataaaggaccaaaaaaaaaaaaaaaagccttagaacagtctcgatatgcaagactgcgatgtgcgatgtacaggaatctcttagggagaaattcttggccagaatttacaacttgttccctattgccacattgctttattaaattggtgtaatggagcatggatttttttatattgtcatatgcagtgataatctaaaattctagagctatgattcatctctgaggatgttttactcatattgcatctagccgccccctacattaaaccaagtgtttgagaagagtttcaagaaatcttaacttcagaaggagttttaggaagttcctattgcaatctctgattaacgtggaaatccattctcttgataaatacttccactaacaaagaggcctctctttaaaagattgtccattccttttctggagagttctaaaagaggataatcaaaaggaaagacccttctttcactggaatttatgtcttagtaagtgttcatttcagatatattcacaagtaaaaagagagtaaactctaagactcaaaaatgggccatttctatgaaataaggacacaacagatcgaagctgaaagatttgatcaaccttatcaattgttgaaagacaagtcttatagaaggaagctcggccaactccaaaactgactcctttccaatgcttagtgatcatctggacacacttgtggaatgtgacattttggtctaacacaagcacagaataacatgtagcatatacccaaatgaaatgaatcactagcgaacggatccttaaagtctacaaaaaccaaccacagggctgtaatgaaagaaagtgatgacagacaagttataacatacagccagccaaattccgaacacagtattttggctgactagtcttggacatgggaagaattatgctgttcaatttacaacttattaaagagggaaagaagtcatcgatacagatggttggttctatatcaaagaagact

SEQ ID NO: 954 - DNA, 13231 bp, Homo sapiens
ctcctgggccgggctctcctgagcgaagagcatcgggaagaggcttccgcggcagcctgcggcccccgcccaggcgaagaggccgggaggagaggagattcccttctgagaacgttcattgagcgtcgatgtgaaggccacggcattgagagacttgacaggatcttgctttgtcgcccaggctggagttcagtggcgcgatcacgactcactgcagcctcaacttctagggctcaggtgatcccccaccacggatcacctgacccaccaccacccccggctaatctttggtattttttgtagagactgggttttgctgtgttgcccaggctgatctcaaactcctgggctcagtgatccaccctcttcagcctcccaaagtgctgggattacaggagtgagccaccgctcctggcctctgagttcttctcatgggaggctgagaaaagtctgggggtctgggacagccagggccgggtttccccttccaggcaatgagaaagaacaggctctgcctcccaccataagagtcaatcccaagttccagatgtgtcagggaagcgatggagagccccagacttgaggcatctgcagacaggttcctgctcagacatccacgtggagggtgttagtatcctgggagccttcagaaccttgaagcatgccagcagaggagaatgagggaagataaaatcaaagtgacttatcacaattaaggaaatgtgctatttcatgtacaactgtgtgtgaggatgagattcctacctgccatactgaggtattatgataagaactaagagagtccaaattcctacaggatgaacagctgagggagcgatgcattccttaggaaggagtttagcttcccgaaggagacggcagctgagataggttctgagaaatagcattttcattggttccccgggcgccgtggctcacgcctgtaatcccagcacttcgggaggccgaggtgggtatcacctgaggtcaggagttcgaaaccagtcaggccaacatggtgaaaccccatctctactaaatacaaaaaagtagccaggtatgatggcgcaggcctataatctcagctacttgggaggctgaggcaggagaatcgcttgaaccttggaggcggaggttgcagtgagccgagattgtgccactgcactccaacctgggcaacaagagctaaactccgtctcaaaaaacccaaaacaacaacaacaacaaaaaacaaaattgaatgttcactggctgagggttagggtgggtggagagaaaatgccagttgtgtggatctgttgatgtaaaacaaaggcctagagggtggtaaactggaagcagttcaatgggacagtgcttgatgggactttggaggtgatgaggtttgatatagtttggatttttgtccctgcccaagtctcatgttgaattgtaatccccagcgctggcagttgggcctggtgggaagtgtttggatcatggtggtggatccctcatggtggatcccagttctcatgagatctggtcatttaaaagtgtgtggcacctccccaccacctctctctctcgctcgcttgctcgctcctgcttttaccatgtgatgtgcctgctccccctttgccttccgccatgattgtaagcttcctgaggcttccctagaagcagatgtcagcattatgcttcctatacagtctgcagaactgtgagccaattaaacttcttttcttataaattacccagtctagatgtttctttatagcaatgcaacaatagcctcttatgagtttggaaagggatctgagcccatatgccaaggaacttgcctgccaaatctggactttatccttcaggccctgggagaccagtgagagggtggcataatccactcttttggaagggtaaatgtggctgtgtgaagtgttggtaggggaaggcagggggtgggagatgagcatatcttgctgcctccttctacctgtcctccagcccccttaggcctgaccatggctgactttgcatccggtagctctgagatacagtgcctttgccaaggaccatatttgaactgatcattaatcaattcattttgcagatcattggtttaggtgtactcaggagaccaacaacaatatcttctctttgtttgacccctcctgtgtcacatgtatgatcacagaagagaccatgtttttggaagagaaacagaactggctttccattgaggcaaatgagggggctgccccatggtggagacacacagaagggtgggagagggactctatctttcattggaatagtctagtaagttaccagttctaacttggcatctaggacatataaatcatgcatttacttatccagcaaccttttctaagcaccttctctgtgtcaggccctgtgctaggtggagctggaagatatagctcacttgcttgtaaggaacttgaagtctgtgtgggggacaaatgtataaacagaaaattacagttcaccatcttagtgttccagaggaaagaagcacttagtatgaggtaccaggaagaggtggggagaagggagtggctttacatccttaagttctgggtgtttgaagagcagccttagacactagccacggaggtgggcttgggtaggccccgccgtggggtttgaagacccaaaagatgttgggtcaaggaggacatgggtgtctagtgtgggagcaagcagaagggtgagctcaccgaagcactgttttacccactgtactacgtttctattgctgctaaaacaaattgccacaaacttagtggcttaaaacaagggcgttatcttccagttctggagggcaggagtctaactcaggtctccctgggctagaatcgaggtgtcagcagggctgggttcctttctggaggctttgggggagcatccatttccttgccttgcccagcttctagaggccacctgcattcctgagttcatggctcccttctgtcttcaaagccaacaacagtgggtgagtcactctcacattgtttcactttgacctcttcttttatttttctgagacaggatcttgctctgttgcccaggctgaagtgcagtgacatgattatggctcactgcacccttgacctccagggctcaaatgatccttccatctcagcctcccaagtagctgggactacaggcatgtagtaccatgctcggctaatttttctattttttgtaaagatggggtctcgctgttgtccaggctagtctccaactcctgcgctcaagtgatcctcctgccttggcctcccaaaatggtgggattacagacatgagccaccacaccctgcccactctgaccctttctgcctcctgcttccactcttataaacgtttgcgatgacattggacccacctggataaaccaggacactctccctattttaaggtcagcagattaacttcctgaattccatctgcaacttttttttcttttttttttttttttgagacagggtttcagtctgttgcccaggctggggtacagtggagcaatcatggctcactgcagccttaacaacaactgggctcaagtgatccttctgcttcagcctcctgagtagctgggactacaggcacgtgccacaacgcccttcaaattttattttttgtagagatggtgtttccctatgttgctcagggaagtcttgaactcctgggctcaagtgatcctcccgctttggcctccaaaagtgctgggattacaggcgtgagccaccgcacctggcccacaggcagcttaattcccttttgccatgtaacccacatattcacagcttctggggattgtgatgtggacattgggggaggcactgttctgcctcccacacccactttaccttcagggtgaggtctcggcctggcctatcctttcatggtatctacctgtaatcatggggaaaagcctttaaaaattaggcaagggaattaaaatcatcacgataagtaaaagcaggcaaggaacttgctggaggagaacagagatagaataaggcagaagtgtctatgtatggggggggggagtcaaaaggggtggtggaggtgattgaggaataaacagatatgaattgcttatttaaggcttgaacctggtgtcatgagagaaatggtggtggtctcaaaaggggccatggggtggggccacagaagagacacggccccatctgcatgttgaccatactcagggtggtgaggaaaccagcgctgtcctgcagctgggggaacctcagtggtctttggggatgagccctgaacctcaagtcaagaagtgtgagttctagtccaggtttcagccacggtgattgagtcatgcacgtgggcctctgacccctcatcagtaaaccgggggctggtctagatgaccccaaggctctcacattcatttctgcactcttggtctctgctgggcttctgggacatcggttagtatggccttttgttaggcacatgccaggactggggctgtgcaggtgatgtggaagggttcctgattccctgttcccactggagcctgctctacagaaggaaccccttggatgttgctgtcccgggcttcagcactcagaactccttgctctttgtggccatcccagctctctctgtcacgtgagcccttgtccccagctgaatcactatgatgagttgtatgagctttgacaacaggtgggggatgacatgcagtccccctgacccaaaggagactgaaacgaagcacctcttggccaggccaccacggtgccccacagccgcttcaccggctgtcccttgtcatggccacgggcccagacctagttcctcctcagtgacggggggttggggcccctacctgccctcagagccctaccaccagtgttgggcattggggctaggctggagctgggctctgagcccagagctggtggtggtttccaggcctgtgggagggtgacagtgaggctgtgctgccgctatcacctccggagagagcggtgcatgggaggtggaaagcactggacctggactgtggctcagttgagggacacatggcatgtacttttaccacacaagtttatttaaataaaagtgaacacatatgcaggctggtgcccgaggggcagggggtggggagggcaggtgggaagcagacagacaatggggtccaggcagagtttgtgtggtgaaccaggctgctggagggagtggctgggggcctcagggcagcgctgggattcagtgctggggcagggggccttgggtgggtgagcctggtgccaggaggtcatttccatccctcacatgcccccctccctttccctgaccccctgggcctacagcactacctcctcagccccctctccctctcctgacatcagccttccccttagctactgagaagccaaaagacaaaataaattagaatgggtgagtcctaccccagcccccagccatggggaagggaagccaagccaggcacactgcgccggagcccgtgctgtcagctctggaaaagaacaggtaaagtgcaaggagaatccagtaagtaaaaatataccaatgactttgtcaaatacacagctgctggctgtcaggagcaggtggctggctggggcgggtggcagcagcaccctgggaagtgttgggcgacacagcagagagacaacggaaataaatagggtgggtgtggacaggggtcccaccaactgggccagcaccacccaggacgggcttctgcctgctttccggccccatgcccccaagcccccctcgcctggctccccagtgctgcagcactgacacaaagcacccggccgaccgtgttaggaaaggactataatgtgggagtggagcagggagggaggcacggggaagctgtgcagtcagccagggctgcggccgccctcagtactcgtcctggtcttcttgttgatgctcttcaatctcatcgtcctcagggggtgcgaatccttcctggagggtgggagagagaggaaagtggtgggccaggcaggccaggcagggcttctcaggttctgtaagtagctgaagagcaaggggtcaggagtccaggagccctgctaatgggtgaccctgggctagtgacttcacctctctctcatcagtaaatgttctccacggtcccttctggccctatcgcgcttctggtcttagggccaggccagactggggagggcccaatgggcctgggagtgctcacctctgtggcatagaggatgccaatgatgcctgagataacagggctgttttcactttcatgctcctggcagatgagctcgatgtcacgaagtttgctgaagtagaagtcacgttccttctccagcccatccactgtcagcttcaagtccaccagctgcttggggacaaagtgatgttcaagccagaggtccccacctcaggttcccctgcctgccctcctctcgtccctgcagacaccccaagggcctggctttggtgacagggctatctcagctacccttacccatcccactcacctgttggttgagttcaagaatttgggcatcagtctcatggccgccatttcgggctgatggaggattcttccggagaatgcaggggggggccacattgctcagccggccagaggtctgcatgttttttgggcctgtgggggacgtcctctgtggaactgcccagaggaaaagagtcaggtaagtccacgtgagcccacagcgcacgtggcaggagacagcctggtgtgaggactgcgggggcaggcccatgcgacaggcaggcactctcacccccctgcccccaccccaggaagggcatctacagctaggccccgagtcttggccacatggacactccagcagctgggcagccctttggcgagcccgggagagcagaaactatagggaactaaacaaggtgtgaggtgttggggcagggagagagctggcctgagggatagaggagagaaattaggacgcaaatttggggaagtagagttggaagggtgcgggaccctctcgtactcatagctagaggaaaggcagctggcacagggtctttcctaacagaagccccagcccaaagccattgtccctgggtggctgcccctccaggggccctgtgtcaggatgggctcttttgccctctgctgggctggaccaggtatctgcacagtggtggccaaatcagggaccccagctcctccccagcgcagccagcatgccgtggcgacttgctcactagcgactgcacctccctagacagagcgggctgcttctagtgcaaagcaagcaggcgggcgagtggggcaggcccaggcagaacagcagtgcagacagaggaggtggctctgctatgacggggtccgacgcgggctggggctgctcctctcccttcccctcccaacgctgctgcttcccaaaggccctattgcttttctcccttcccctccaggacccagacaaagcctcgtttctagagactcatcttttgaggacttaggactattgggcctttagagtggggaaaggtgtgatccagcttggcaactcctgcccctggccatccagggggcagggggcaagaaggggctgtggtgctggcaccaggctcttggtctggatgcacctggatggagaaaccaagccaccttgctgccccatcatcttgaggcaaacaagttagctcgtgctatgaaacaaagtgccttgggcctcctaccccagttgccaccatggctggtgctggtggctctcctcttagaccaatttgtggagctctctcacccactactttcactcccccggtctaactggccagcaggcggcgtcatccgaactccgtgataacaagtctcctccaggctggcagggccgggccgtggcccagggggcactcctggctatagaggcctgccggcccggccccccacgctccctcccccggctcgggcacgttacctgctgtgccaatgagtttcttggatttgttgaagatctgatcacctgggttaggaggtggcgctacgtcctggccctgccgcgccagcagagggttgtaatcctttccatcatagtttgcgtcaaagaatttcttaaaccactgaataaactcaaaattatcttggaattttcctttcactaatttctctacaggaatgatctgaaatagaccacataagcagagtactttagccacctgctgctgtaggaccgccttcctctgctgagggccactgctctcaggaaagccagcccctgggctgcagcgtcctccaccttctccacttgcccccctcccacggcaccagagcagacaggtaggctggtaggccctagtgtcagatccagaggcatcccttctctacaggcaccgtgtggaagaactgtgtggggaggcgtcccttggctctactgcctgcgtgtgggctgggggtctgcagccaccgaggcagtagagtgagcagagacactttcttgggccctacagagacagagagaggtggaacttcacaggagcggtgcacagagctcagtgttggggtgggcagggtccagagaggaggaagggaaaggaatgttgtcatgatggcatggcaagtgttgtgggcttttccattgtgccttgagcagggggaaaattccctctggagagtcgggaggtggagggaggcacgagcaccggaatgaccccagcagccccagttgcctgggctggtgggtcctcttcttccccagggtcacactgctcctcagggccccccagagcgcaggcacctactttgtcaacacccatcttcttgaaagctgcttgcagcaccttgaagttgtggatgtattcgtgctctagtttggcctggaacttcactttcctcaagtgcacacagccggggaagagcatgtccatgaactggcagtaggctgcccctgtggagaaggatggctggctgaggggtcttgctgctctccttctgtgagctgctctctctcacttccccaaaccccgtctcctcttctctctccttgttctgggccagggaccagtcctactttcaggatagacatggccagaatccccccagctttccaagaataaaagcaatgactatttattgatgcgtattatgaaccagcaccacaccaaacactgcatgtaggtagggcaatcccaacaggaactctagttagttggtgatactatctccatcttatggatgagaaaactgaggcctagggcagtatagtgacttgcccaaggttgcaccaccagaagagctgagagctggacccagagaggtgtggtcagacctgtggctctgctgccatcctggctctcagctccccgctcctcctttccctgcagtccttcatggtgcctctcctgctcttctctttccctgcttccatttcttgacttcagctccagacagtctgactagttcagggcctccagctctcctccttaatctaatcacaagctacagctatgggctgcataacgatggtttggtcaacgatgaaccacatatatgatggtggtcctacaggattataataccatgtttttattttattatcaccttttctatgtttaggtatgtttagatgtgcaaatacttaccatgtgttaaaactgtctgcagtatttagtacagaaacatgctgtccatgtttttagcctaggagtagtaggctataccatatagccgaggtgtgtagtaggctacaccatccaggtttgtgtaaatacactctgtgatgttcacacaacaacaacatcgcctaaggatgcatttctctggccacatcagtcattcagccatgcatgactgtatattccctgttgtggctgctctgccttccgacctttctttcctttccttccagcagggccacttcccatattcccagcctcctacctgaacaaagctgttctatcttggtatagttgaggtgcagggagtcgttgacccatgcaagcatatcatggcgactcagattttcactggtcacagatgtggagtacacattgacggccataccccagctggaaagcaagaagaaaggtgaggtcagcactggggcctcatgtagctccttagctgtcaagagagaggggctgtatgatactgggaagtaagaaacattccctccagattggcctcgcagtttatccccagagggagggtctttattccttagacatttcatgagcatctactatatgctagacgtgcaccaggagccagtaattccaagttaattaagaaatggcctctgccttgaggcatttacagacaggcagatcccctcagtagggagtgatgaggcagtgaaacaggcacataaatgttcagggacagcacaaagaagggtgtgagcgcatctgctgggcagggtcagcgaaggcttcagagcagagatgttggagcctgagaagaataggaattttccagacataaaaagggatgggtggaaggcatttcagccacagggactagcaagaacaaaggcagagcttattccgggcactctgagtcgtggagcaggcccggggagcagatttttctgttggggtgtggcacaatgaggttggcagggacaggttgccaggcccttgtttaccagaaggaggaatctggactttctatttggatgacaggaagccattagagggttttaagcgacagtaacctgaccagatttgtgttttagaaagccagctaacctttgcctctgctccgacttcagactccacattcctgtggctgatgcagaggcatctaaattctgcttgtccacaacctttccttagaatatgcttctggctcctgtattcattatcccagtgaatgtcatcaccagcaattaatcaccaccttagaaacctgcggggtcatcccagacagcttactctccctcatgcacctatcaagtcattcctcaagtcctggaacccgacttcctcaattcgcccttttctgcttaccctcaggatttatgcataccgttgtcccttggtattcatgagggaatttgttccagaacatctccccataccaaagtcaatgcacagtcaagtcccttatataaaatgatgtagtatttacagttaacctacacacatcctcctgtatgatttaaatcatctctagattacttataatacctactaccatgtcacttcgatgtaaatagttgttatactgtattgtttaggaaatcatgacatgaaaaaaaagtctgtaagcaatgcaacaatcctttttttttcctgaatatttttgatcggtatttgattgaatccacagatgtggatcccacggatgtgaagggctgactgtattttctctctagcccaggctagcaggagcctcctaaaaggccttccagcctccagtctctccctcctcttaatccatccttgacattgctgtagtcagaatctacctaaaagcaggtctggccaccgccctcccccacttcaagtcctttcagccagcagtcataaaagagacactccttggccgaatttgccttgcagacttaaactgttcagcactcatagtgttggaaacagttttgaattagtgcccaatattttaaagttcagatgtttaacaacttgggatttctggcttcttttggccactctgaccctatgctcccgcactgaaaccagcagttggagtggagccagcagtgagcctccttcccaccccagaggccaagggtcagctgctgctgctaactgacttgcgctgttaagaaaaggacatatttcttgtaaccacatctttatcagaaatggaaaaacaagataggtcaaaaggactgtgttttccgagaattgtgaggacatgtgtttctggagtgagtgaagaatatttcttcaggtttaatatgtaaagtgtctctgtgaaataagatacatcttatacaccttatattcttacagaaagaatatttccctgcctgtcgcaggcatctgctgttatcatgtgactcctcctgaccacttatcaaactcataaggggaccccacctcttcagccttatctcctactttgattccccagttaggagctataggcagcttcctactcaccctctgtctggaatgccgtccccaccccaaagttcattcattctctgttccatggttctcaattgtggccccagacctgcgcagtgggactatatggggatcagctggttagaaattccaattctcttgtcctcccccagacctaactaaatgagaaactgcctttgaccaagatgcccggaggatctgcaggcacagtcctgtttgagtagtactgctttagacagggaggctcagcaaggcatctgcagagctgtgtgccacttacgttcccacccctgaccccaagtacataggacagagcatgtttaacttaaatgaatgctttgaagaaaaatcatgagagaaaaccctcttctttattcctagttcttcctcctttgaaaaataaaccttgtccttcattgcccaggcaaagggaggccaggcggggccaaaaagccaagagaaacagaaatgaattattgtcttgggagcgcctaaagactcaagacctggcaatttcagagctttccgagagtaatgttgactgcacttgagtttcctcctccacaacgtctctgcgcccactgccctgcatcttggcccttgcgctcaccattggacttgtttaaatgcctgcgccccatgtcttgaagccaagagtggggtatccaggcctgtcacaggcaagacgttcagtaacgttgaaccattgagtgatgcctcatgtcctctcctctttctgaatcatgtctcatcaccttctggcctgggtccccctgccatccccctgccatacccccaccatccccccgccatcctccctcccccagcactcagcctcaggactctgctttagctccaggggactttttctgaccccctctgtgggagacatgtgcccatgatcctacagcaccctgggcacggctcttcatggcatcccacatggtctgttgaaatcatgtgtgtgagagcgggtgcggtggctcatgcctgtaatgccagcactttgggaggctgaggggggtgccgatcacctaagccaggagttcaagaccagcctggccaacatggcaaaaccctgtctctactaaaattagccaggcctgtaatcctagctactagggaggctgag

SEQ ID NO: 955 - DNA, 748 bp, Homo sapiens
tctcaaaatcacaatgttaaaaaaaaatacaacttttgtaataacactgaaattcagtctgttgatcttcttataacaagtatagctaactaatgaggacatgaaatcactaacacagttgttgtctgcttacgtaagtaaaacagctgcacaagctgtgaaaagtccagagaaagcacgtaaaatgatccatcacacaaagtccaccattctttcccaaatccttgttacagaaaaccaaccaacaaacaaacaaatcaacaactcattctctagaagtacagggtgggacatggcaaataaagaaaataagctggcttgtgcaggccacctgcctgaaatatgaggtcatgattgtcaaacacatttggtcaactccagtaacttcagttcttcacaaagagaaaaccagtcattaaaccatagtggagactttttgtttttattatttttgtttttattatgttttgttttgttttgtttagactgtgccgcaatggcacaagatctgttcaggaggaatgtgacattaaatgcagctttgactttctggaggaagggaggtataaatgaacctatttggtaaggagagataattttagagttatggtggattgcctgcctatgctctctaatcactgacaggaaaaaaaaaacagtacatctcactcagctgctgtgaatacttggtgccttagtatagtcatctcttaaaagcaaatttgaagaatatggaatagttggtgat

SEQ ID NO: 956 - DNA, 1491 bp, Homo sapiens
gttgacagagagttgaagactcccgtgcttctgggaatagtcattgtgagcatgtggtcagcccggttgctagaattcttcccatgagcagcttcaggggctgactgtggcctcatgcccagtacctttagccattttaatttaccaaacctcattgtcccattctcttttcaggttcttggccataaaatatggcttttggaaaaataaagctgagacttggagttcacggtgggggctcccccatctgtgaacagaagcagaagtttggaactgccttctttactgctcgagagggaaaacttgagtgaaaaccaggatgctggcgaatgttgagtagctaagctgcacaggaaataccacttgatgacctgcgatctggggaagccgcgccagggctctgcgaagctgcggacgagggaggcgtcagtgtgggggctgcagctcagctccgggggggacgcgcctttctccacgggacctggggctcaggtgctcacgaggctggggcgctgcaggccacccgcaggggaaactgaggccctccattttgtggggctggaagacctttccttccaaaagcaggtgtaggcgggagcacctgtgcagtccctctgttcagatcctcacccacttttaaatcaggtaattgcttttcttgttattgcattgagttccttatgtattttagatcgccgggtacccttcattttactcctgaggctgtaacttggacaaagcgctttctgctgctttggatgaaaaattcttttcctccacaggaaacagcagatgaaatgcacagtgtgaaggacaaggattctgctgagagaattgctccgagggttgctcaagtgatcatgggaaataatgcatcaaaccattctttaggtatttttttaaattaggaggtaaaaaatctgtgctgtttgccaaaatgattcttacacagacaagctaggaaaattgctctgaaacatgacacagactcctgatttggcccaactagggtgtgaaggatgaaatccatcctgagcccttcatccctctgctttctctggtgcagatgcagctcaggtgtgccttttcttcgcctgtgcccatccacctgagatggaccataaccataaaagtcagaaggcactgacccttcaggacgtgacagggttaaaagatgctggagggaaagtctgtcattgacttttattcacttcctttctccattctgccatttggaagaaggtaagcaacttaacactattttagaccatatgttgtaaactagcaggaaaatgcctttgagctgatgatggtggcccgaacacagtgaacctgtcttaaatccctgctttaaacccttaagggtgtcacttacaagagatactatttgaagtcttcccatgcatgtgtagggtggggggagtaccaacagctcatcgaatgggctccatttgaaagatctggatggttgcctttatttgtaactagttt

SEQ ID NO: 957 - DNA, 894 bp, Homo sapiens
actctgtgttagccaaatgccagcttgcccacccaaatgctggactgaagtctaacacgttccaacagcaaatctgcagacactccacccaccaggacagctgctcacgcgtgcaaccctgtgggtccagaagatttcgagtgcagacacgtgggattcaggagactggttcccaggctctctgcatccataggagcctgctggcaaatgtgctgagaatggacatgcctgattcgctccaaggaactgctcctttcctgtgcctctttcatcatggcctgacacaggcgtcacgagggcaaggaaggccttggagccccctcatctgtccctggggcatcttgtacacaggtgggctccacatgaaggatgagggaccaccaaggctgagttcagtaagagaactcccccagtaatgggtaagagcccccagtaacatggtcggcttgtcatcctttgattttaacaaaatggaaggggaatctcactgagctaaaaatcaatagatcattgaaaataatccttaatgacagagaatggatgggccacaatgttttggcatatagctcaggcgttcagtgaaaatggcactgctataacaagactcctctctctccatttatttacatgaacacattttcagacattctacagaaacaaaaagaagcgaccaccaaaaggagggaaaaaccaggagcgcacacgtttctgacaaggtcttctctggaaatgagtcaggtgtgctcatgaactgagtgaaaaaccaccacacccagctcgctaagagatgcatctcagagcaatcataactttttatgtccaacaattatcaaagtatgtaatgtatcctaattgcttgatgtgaacaagtgataattatgataataattccat

SEQ ID NO: 958 - DNA, 1236 bp, Homo sapiens
aaaacatgtatattatatttatccacctgtcatcattttcagaaatctttattatttctttagattcaaattttcatctggtagcatactctttctgtgtgaaagatttaacttcaatatttcttgcagtgttgatatcctgttgataaagtttttcagctttcatatgtccaaaacactctttatttcacctgcatttttgaaagatacttttgatggctattgaagccttggtagatagctttgattttattcacttttgttttcaatactgtgaagttgatgctctgttttccactggcttggatcattttttgatgagaaatctgctatcattcttatttttgttccttgttatatgatgtgtatttttttttcctttgctttaaatactttctcttcactgccgatggtcagcattttgataatgctgcaacttggtgtggtgttcttcatatttcttctgcttggggttgattgagtttcttgtatctgtgggtttataacttttgtcaaaattgaaattttgtctacaatttctttaaatatttttgtattctctcttcttttcctctcttctgggattccagctgtgaagtgatgagccacttgacattattccacagctcactgattttttttttttttttttattgagatggagtttcactctgtcactcaggctggagtgcagtggcaccatcttggctcactgcaacctctgctgcccaggttcaagcgattctcatgcctcagcttcccgagtagctgggattacaggtgcctgtcaccacatctggctaattttcttgtatttttattagagatgggttttcgccatgttggccaggctgttctcgaacttctaacctcaggtcatccacccttctcggcctccccaagtgctgggattacaggcatgagccactgcatccggcctgatgttcatttcttagactttttttctgtgtgtgtgtgtgtgtgtgtgtgtgtgtgtgtgtgtgtgtttaacttagctggttcctattgctatgtgttccagttctaaatttttcctgcaatatctaatttgctattaatgtcattcagcatatttttctgagatattttattttcaatgtctagaaatttgttttgagcttatttatatcttgcatttatttctacatgattttcatactctcctctcccttcttgaacatgtcaactttatttatagtagctcttttaatattt

SEQ ID NO: 959 - DNA, 15126 bp, Homo sapiens
ccttcgctctggtgaggtgaaccgcagtctgaggaagacttcgctcaatcgtccctttccacacccagggtactggtttaaggtaattaagcaaatatggagcagtatgttaattgagtctctgacgacttaatgtttagtcgaaatcctttgtggaattgtccagctatttcatattctggtgcactatgctttaaagcacaatggagagccagactcgtgggtttgtatgttgtactcattttaggctggaaatgaactctcatttataaaggatatatagatatataattatattatgtttaaataatttatacaaatatataaatttttatttccatattatttccataggtttttgaggaacaggtggtgtttggttacatgagtaagttctttagtgatgatttgtgagattttgatgtacccatcatcgagcagtatacactgaacctaattttgtagtcttttatccctctcccccttcccaacctttccccgagtcccgaaagtccattgtgtcattcctatgcctttgcatcctcaaagcttagctctcacttgtgagtgagaacatacgatgtttggttttccattcctgagttacttcatttagaataagaataatagtctccagtcccatccaggtttctgcgaatgccatttattcattcctttttatggctgagtagtattccatcattatatatatatcacatatatatataccacatatatatatatatatatatatatcacagtttctttatccactcattgattcatgggcatttgggttggctccacatttttgcaattgcgaattgtgctgctataaatatgcatgggcaagtatctttttcgtgtaatgacttcttttcctctgggtagatacccagtagtgggattactggatcaaatggtagttctacttttagttctctaaggaatctccacactgttttccatagtggtgtactagtttacagtcccaccagtaatgtagaagtgttcccttttcaccgcatccacaccaacagctattattttttgatttttttgattatggccattcttgcggaagtagggtggtacatacggcatagcagttttgacttggaattccctgatcattagtgatcttgagcattttttcatatgtttgttggccatttgtgtatcttcttttgagaattgtctattcatgtttttttgttttttcttgagacagagttttgctcttgttgcccaggctggagtgcaatggcgtgatcttggctcaccgcaacttccgcctcccaggttcaagtgattctcctgcctcagccttccgaccagctggtattaccggcatgtgccaccacacccggctaattttgtatttttagtagagacagtgtttctccctgttggtcaggctggtctcgaactccagacctcaggtgatctgcctgcctcagcctcccaaagtgctgggattacaagcatgagccactgcccccagcccttttcatgtttttagcccagtttttgttaggattttttttttcttgattatttgtttgaattcattgtagattctggatagtagtcctttgtcagatgcatagattatgaagattttctcccactctgtgggttgtctgtttactctgctaactcttccctttgccatgcaaaagctctttcatttaatcaagtcccagctatttatctttcttttcattgcatttgcttttgggttcttggtcatgaaatccttgcctaagccaatgtctacaaggggttttccgatgttatcttctagaatttttatagtttcaggtcttagatttaagttcttgatccatcttgagtttatttttgtataaggtgagagatgcagatccagttttattctcctacgtgtggcttgccaattatcccagcaccatttgttgaatagggtgtcttttcccccactttatgtttttgtttgctttgttgaaaatcagtcggctgtaagtatttgggtttatttctgggttctctattctgttccattggtctatatgcctatttttatgccagtaccatgctgttttggtgacagtagccttatagtatagtttgaaatcaggtaatgtgatgtctccagatttgttcttttcgcttcatcttgcattggctatgcaggctcttttttggttccatatggattttaggattattttttctagttctgtgaagaatgatggtggtattttgatgggaattgcattgaatttgtagattgcttttggcagtatggtcattttcacaatgttgattctacccatccatgagcatgggatgtgtttccatttgtttgcctcgtctgtgatttctttcagcagtgttttgtagttttccttgtagagttctttctccttctttgttaggtatgttcctaagtattttatttttctaataaaacaaaatacttttgccgctattgtcaaaggaattgagttctttgtttgattctcagcttggttgctgttggtgtataggagggctactgatgtgtgtacattagttttgtatcctgaaactttgctgacttcttttatcagttctaggagcattttggagaagtctttagggttttctagatatacaatcatatcatcagcaaacagcaacagtttgactgcctctttactgacttggatgccctttctttctttctcttctctgattgctctggatgggacttccagtactatgttgaagaggagtggtgagagtgggcatccttgtcttattccagttgtcagagggaatgctttcaacttttccccattcagtattgtgttggctgtgggtttgtcatagatggcttttattacattgtggtatgtcccttgtatgccagttttgctgagggttttaatcataaagggatgctggattttgtcaagtgctttttctgcgtctgttaagatgatcatgtgatttgtttttaattctgtttatgtgatgtatcacatttattgacttgcatatgttaaaccatccctgcatccctggtatgaaacccacttgatcatggtggattatctttttgatatgttgttggattcaattagctagtattttgttaaggatttttacatctatgttcatctggaatattggtctgtagtttggttttttttttttttttttttttgggttatgttctttcctggttttggtattagggtgatactggcttcatagaatgctttagggaggatttcctctttctgtgtcttgtggaatagtgacattcttctttaaatgtctttaaatgtcacaggatcagctgtgaatctgatcctggactttttttgttggtgattttttttattaccgtttcaatcttgctgcttgttattggtctgttcagagtatctaattcttcctgattcaagctaggtgggttgtatctttccaggaatttatccatctcctctaggttttctagtttatgtgtgtaaaggtgttcatagtagccttgaatgatcttttgtatttctgtggtgtcaattgtagtatctcccatttcatttctaattgagcttatttggattttctctcttcttttcttgattaatctttttaatggtctatcaattttatttatcttttcagagaaccagctttttgtttctttttttttttttttgtgatggagtcttgctctgtcacccaggatagagtgcagtggcgcaatctcagctcactgcaagctctgcctcccgggttcatgccattctcctgcctcagcctcctgagtagctgggactacaggtgcccaccaccacgccgggctaattttttgtatttttttagtagagacggggtttcactgtgttagccaggatggtctcgatctcctgaccttgtgatctgcccgcctcggcctcccaaagtgctgggattacaggcgtgagccactgcgcccggcctatttcatttgtcttttgtatttttttttttccatttcaattccatttagctctgctccgatcttatttcctttcttctgctgggtttgggtttggtttgttcttgtttctctagtttcttgaggtatgaccttagattgtctatttgtgctctttcagactttttgatgtaggcatttagggctatgagctttcctcttagcaccacctttgctgtatcccagaggttttgataagtcatgtcactattgttgttcagcttgaaaaatttttaaatttccatcttgatttcatttttgacccagttgtcattcaggagcaggttatttaatttccatgtatttgcatagttttgaaggttccttttggagttgattttcagttttattccactgtggtctgagagagtgcttgatataattttaattttcttaaatttattgagatttgttttgtggcctatcatatgatctatcttggagaaagttccacgtgctgatgaatagaatgtatattctgcagttgtttggtagaatgttacgtaaacatctgttaagcccatttgttccagggtatagtttaaatccattgtttctttgttgactttctgtcttgatgacctgtctagtactgtgagtggagtattgaaatcccccactattattgtgttgctgtctatcttatttcttaggtctggtagtaattgtcttataaacttgggagctccagtcttaagtgcatatatatttaggattgtgatattttcctattggacaaggccttttgtcattatgtaatgtccctctttgtcttttttaactgtggttactttaaagtttgttttgtctgatataaaaatagctattcctccttgcttttggtgtccatttgcatgaaatgtctttttccacccctttaccttaagtttatgcaaatccttatgtgttaggtgggtctcttgaaggcagcaaatagtttgttggtgaattcttatccattctgcaattctgcatcttttaagtggagcatttagactatttacattcaatgttagtattgagatatgaggtgctattccattcattgtgctatttgttgcttgtataccttgggttgttttttttttaaattgtatttttgttgtataggtcctgtgagattgatgctttaaagaggatctgttttgatgtgcttccaggatttttttcaagatttagagctccttttagcagttcttgtagtgctggcttggtagtggtgaattctctcagcatttgtctgaaaaaaactgtatctttccttcatttatgtagcttagtttcgctggatacaaaattcttgggtgataattgttttgtttaaggagactgaaaatagggccccagtcccttctagcttgtagggtttcttctgaaaaatctgctgttaatctgatagattttcctttataggttacctggtgcttttgcctcacagctcttaagattctttccttcattttaacttttgataacctgatgacaatgtgcctaggcgatgatctttttgcgatgagtttcccaggtgttctttgagcttcttgtatttggatgtctaggtctttagcaaggctggggaagttttcctcaattattcccccaaatatgttttccaaacttttagatttctcttcttcttccacaagaatgccaattattcttaggtttggttgtttaacataatcccagacttcttggagtctttgttcattttttctttattcttttttctttgtatttgttggattggattaatttgaaaaccttgtcttcgagctctgaagttctttcttctgcttgttcgattctattgctgagactttccagagcattttgcatttctctaagtgcatccattgtttcctgaagtttcgattgttttttatttatgctatctatttcacggaagttttctcccctcattttgttttttgttgttgttgttgttgttgttgtttcttttgtttagtagagacggggttttgccatgttgctcaggctggccttgaactcctggcctcaagtgatcgacccacctcggcctcccaaagggctaggattacaggtatgagccaccatacctggcctccccgtatttcctcttatttttttttatttctttaaattgggcttcacctgtctctggtgcgtctttgattagcttagtaactgacctgaattctttttcaggtaaatcagggatttcatcttggtttggatccattgctggtgagctagtgtgattttttggggggtgttaaagagccttgttttgtcatattaccagaattgtttttctggttccttctcatttgggtagtctatgtccgatggaaggtctagggctcaaggctgctgttcagcttcatttgtcccatgaggtgttcccttgatgtagtactctcccccttttcctagggatgtggcttcctgagagccaagctgtagtgattgttatctctcttctggatctagccacccagcaagtctatcaggctctgggctggtattgggggttgtctgcactgagtcctatgatgtgaaccatccacaggtctctcgaggctctgtgtgtgtgtgtgtgtgtgtgtctgtgtgtgtgtgtgtgtgtgtgtgtgtgtatatatatatatatttatttttttgagacggagtcttcctctgtcaccaggctggagtgcaagtggtgtgatcttggctcactgcaacctctgcctcccaggttcaagtgattctcctgcctcagcctcccgagtagctgggactacagccgtgcaccaccacgcccagctaatttttgttatttttagtagagacagggtttcactacattggccaggatgatctcaatctcttgatctcatgatctgctcaccttggcctcccaaagtgctgggattacaggtgtgagtcactgtgcctggtctttttttcttcttttttttttttttgagatggagtctcacaccatcattctggctggagtgcaatggcacgatctcggctcactgcaacctctgcctcccaggttcaagcaattcttctgcctcagcctcccgagtagccgggattacaggtgcccgccaccatgcccagctaattttttgtatttttagtagagacagggtttcaccgtgttgatcaggctggtcttgaactcctgacctcgcgatctgcccgcctcagcctcccaaagtgctgggattagaggcatgagccaccacacccggccgagtctgtatattttttaacaaccagtttgtgatctgaaattggcataagattcctattgtcacacatgtgtttgcaattaattcaaaagtatggacatgtaactattggataagtttgtcatcacgtttatgaatctgattttaaaagacagatctgttatttgggcaagagttgaatgaagctccgtaagtgctccttccctcctctctttctcccagagggtcatgctgtttggcccaggctggagtgtgcggtggcatagtcatagctcattgcagcctcaaccttctgggctccagcaatcctcccacctcaatttcccaagtagctggaaccagaagtgcatgccaccacacccggctaactttttaaagtttttttgtagacaaggggtcacactatgttgtccaggctggcctttgaactcctaggttcaagtgccaccgcccaccttggcctcccaaagtgctggaattacaggcatgagtcatcataccctgccaaataatttatttttaaccaaacttttaaagtattataaccattatagagttgctgttgtcttctgcttttaaaaggtaatggaggagaaactggaaattccgcctcttgaataattcctgttgcttcccataatcatatagaaaactctaaattgtgcctttaaagttttaggtttttaaaagaatacataaatttacttcagagtatcttatatttggaggaaatactccctatcctgttcaggctggtatgttccatccctgtctcagccagcacgttaactcccaaaatttcctaaatacaactttctcataattcaaagtctttgttaggtcttttctaagaggccttagcagaccgtctttccaaacattttcatgtatttacttcaaaacagttgataatctattgagtttgttttctgtcttatccctagtagatggtaaatcttcctcattttgtaatgtttaatacagttccaagtttatttggtggaatgtcaagattgttcctgtaaatttgtggccagtgaacagtggcacatatttgtatttatgcgtgtgtgcttacactctctgtagtgcagcacaatttttagttagtagcagaaaaacactaaccctgatgtacccaaaacttcgtgtttgagggaaaaaatttagatggctcagaactatgtcgcacatgtgatatagcaggagagcaagcgagatagagcgcgatgtagatatagcttcactttaatccgaggcatttgcaagttgctggacctagatgattctttatccagaggactcccataggggctggattaatttctaagactggggaatcccaacttactttggtagataattctaggaggcctttcaaagtgctgggggtgggggtgctgttcctacttcaaactaagccagtgttgcaactgcaccctgttcttcacaagtctttttggatcatctcagctgcagaaatcctctcttacctctctgatacactttttgttgtttttaagagacagcatcttgctgtgtcacccaggctggagtgcaatggtgcaatcatagctcatcatagtgtcgaaatcccaggctcaaacaatcctcccacctcagcctcctgagtagctaggactacaggtgcacaccaccacacccatctaattaaaaaaaaaaattgaggactgggcccagtggctcatgcctgtaatcctagcaccttgggaggccgaggcgggcagaccacttgaggtcaggagttcaagaccagcctggccaacatggtgaaaccctgtctctactaaaaacacaaaaaaaaattagccaggcatggtgacacacatctgtaatcccagctactcaggaggatgaggcacaagaatcacttgaacccaggaggcagaggttgcagtgagccgagattgtgccactgcactccagcctggacaagagagagagactccgtctcaataaataaataaaattttgtagcaagagtctatgttgcccaggttggtctcaaactcctggcctcaagcagtcctcccaccttggcctcccgaagtgctgagattataggcatgagctactgtgcctggcctggtacactatttatccagcataaattggggtattttaacataatctatgcagcctatcatcagttttttctacacaggtgatacagagaccagtggcagagttatgatgaacagtagcatccaagattcagaagcagcatattacttcaagcagcttacccaaaccacatatacaaaagagcagtcatgactccagtcagagaagaaaaaaaaaaatccagatttagatctagtcctacaataccctagactccatctccatctccagactctgcctctccctcagtactctcaggtcatgttcacctgtttgtcttctaggatgcctacaggactgcctgcttcaggttctttacatttgttctctctgctgaacacttatagcacaaatatccttagagagaccttccctgaccacccaaatacaaataatctccactccatttcccaagtcagtctctatcacattaccttatgttatttcttctactgcattatcactgtctaaaattcctatttacgaattgtctctctactaggatatcatacatggatgtgatacatgaggtcaggagacttcatctgtatttttttcagatgaatccccagtgtctagcatagtatctggatcataataaatgataaatttgtgaatggattgattcacctgaattatttcagcacaaactaaattgtagtaatcacacagttggtttttaataattcttcatatttaagaacaaaagaactaccctcatcttcaaagaaatcagacacaattttttttttgttttactaactcatttaggaattcttttcttttctggaaaataagcttatgctagactaattttcaaggctgaatatttttcttcaaatgaaataaatataaacacatttctatatacacagcatttttattaaatatactctgtgagaaaaagaacaccctaaagtgccagatttcatgtaaatccaataacttagtaaatacaatggtgaaaaaaaatcagagggaaacataatttaaataatcttataaaagagcaagaacatatcttaatcttaagaaaacaatcatcaaaatataaaagggaaagaaatctcttttgtagaagaatatatttcaaattccacctgttgatcatttcatttaaaaaattctattctaaacacatgggcagtctctcttaccaatatatatatttaaatcaatggtagaaagggaatttagactactcattcacactgagataaagtgacatttttgttgcacaacagtattgctcactggcactaacagtggaagatggagaaagtagatttctggattcaattgttagcagcagaaatggactaatgctaaaaatttagaaaaaaatagtccaagctgtagcgatttccaagtaatacaaacattaaccaaacattgccaatttgtaacgggctgtgaaaaacatatgaaaatactctacattgaatactagctttatgttactttctattaaagatattcagtgggcatattctaaattatatagggcttctatagagacctaaactagcaagtataatatgaagctaacaggacagtgtcagcatatcttgggatgttctagccaatgtttggctacaagtatttggaaggggtcaaataactatatgcacattcaaaatgaatacttataaaaagaaatcttaatgtatcagatatccacagactgaaaagtgttacacatgttgtggggggaaaatactgatggttggctgaatgaccaattaaacataccacttatgaaaagctgggtgattcaggtgcaaaaaaatatatatgcacacatatctctctaataacatcctaccaacatatatatgttgcatgacatagttaaagctgtgttaccaaactaggatgtgtaaagtatcaatgtagttaaaattaaattttaagtaaaaagctgctgctacttaaacaagagagtgaactttggggtttattcaagaattagttctcatatataaaaaagtttgatattaataaacaattctggtcaccataaggttttagacagtatagaaacttacagaaaagtgtttttggaccactttaaatagttggaggaagcaaataaaaggattaaactggattatgagtatgaatgcatttatgatcaaaattaacacaccaaaaaaatcaaaccacatttcacagcagaacctgcaaaaacgtttgtattcatcttttttgaaccataaaaaagaatgatttagtcttgtctaatacgacttttaagcaacaaaaataatttaatcatgaagtatcagcttgattatgaatatattctattatctgtatcagttggtaaattaactgtgttacccaaaaaggctgaccagctctaactagtatgaacaggatattgaattcattaatgaatatataactattttgagcatacaaataatctctggttttacacccactacatttcagaatcctgtaaactgtgaggcatacaatatgtttaatgtggcagaaaatcatatgaaatgattattttattctgttcagtccttttcccattaagcatgcaaacaccgtcataaccatctttggtttcacttctacgaggtcatcaggtaatgcatatatccgggcaccgatctttcgagcaactgaaatggcgtatcttgaagagacaagaaaaatatcttggtgttatccactgtgttttcacttaacatattttaacaaaagagtgaaatattttgacaagattagttttacgaaaaggttaagtttgtgagtcttaaatctaagactcacatataagttatatttaaaaatatgaattttaagggcatagtaacttttcctataaggattttagagaattaaagggccatgtattgtaatataaaccataaaggcttacttagcattgttcagcttgtcctcatcagataagttttctctcctgatcatttcttgacgaactgcatttggtgcaatggcatctattaaatctaggacaggtaaacttgtgcttatagatttatcctagaaaataaagcatagatgaacattcataaacatctgacctttaattttcattattttcagactcttctgatcatataactgaaggcaatctacaaattctttgtacttaacctaacgttcagcttttctgcaaccagcacacataaataaaccctttaaaatatacttttccttgaatctttatatataatatagagttgtcaccatatctgaataaggtttgtggacatgatagctcctaagtatgctaactatagtgtccattctgtaaaaaatacaaaacttttgaaagggaatagatgaatttttaattaacaattttataaattctactcacatatttcttagaccatgaatccaaaagccttcccttaatatttttcagaaagaaaaatgaaatagtgaaagggaactaacacttacaaagacattgtcttgttgttttacatgttttagtttatttaatccaccttttaaaccctagcatcttgatagtaaaggaattcttttttaaaaaaagatgaagaatataaagttaagatagctcaaatgacttgtttacacaaccagtaaatacagaacccatgacagtctgactctaaaatgcccaagagtctctccatttttaagttaccaccaaggcaagctaaaaatggacaactaaattatagtgaatagcgcactgcagatgaaatcagacatcctggtctgaactgatttttaccacttatcagtacttgaacaaattatttgttttctctctcagcttgaatagtggccaccactgcttgcctacccagaatctacacactctttacttctttcatacaagtagaacccatatttttgctctatatccatacctccttcacacagacatcagcttcaaggaaagctgacattcatagttccaggagtgaacctaaattaatctaggtcaagcattctcaataggggtagggtgataaccttgtttatgtataaagcatacagtgcataaacaggtatacagtgtatctctgcattaaaatttcatgggagagacaaaaacggaaaaaaaggtctaaaaatattccttagaggataattttcttttaagatttcaaaacactggtctaagccaaatagaggaatgctattctattaccacagtaatttaatttgggcctatgttatggaaagccagcaacccctcctcctggatgtgaatgagagaatgaaacctctgtcacaagcagcaactatcctatgaccaaaaggaaaaccagctttagggtgaagctggcacattagatggcaaagcagagatgggaaaaaaaaaaaaaaaaaagagtcctgaatgacattcttcaattattggttcaaccaatccagaagtctaccctacctctggattactgttattgtagtcaacacctttccttttggtttaaaccacttgaaattgggtttctgttacttgaagccagagcaccctttcctaatctctaaagtagaatgtcataggattcttaggaatactgaggtggtataggtgaaaacatctagtataggctctagccaaatgtcagttcttaatcaatatctaataaaacaatctgaagccatgtgaagaagagtaacagcttctttgagccacaatctatgagccacttcatttattaattttttttttttttttgacgcagagtctcgctctgttgcccaggctggcgtgcagtgttgccatcttggctcactgcaagctctgcctcccaggttcatgccattctcctgcctcagcctcctgagtagctgggactacaggcgccggccaccacacccggctgatatttttgtatttttagtagagatggggtttcgccgtgttagccaggatggttgtgatctcctgacctcgtgatccacccgcctcggcctcccaccgtggtgggattacaggcctgagccactgtgcccggcctcatttattaattttagaaaaatttatattcttatgttcatgttatgatacagatttttgggcaggaatgttcattttatgatacagatctttggccaggggtaatgttcattttatgatacagatctctgggcaggggtaagagagagagggtaaaaataattaggtcctttaagtctatctgatgctggtaatctggatctgctttttgtatcttttctgtttctgagaaatcagtctgcagaccacctacatgaaaatcatgtggggtatttgttaaaagtgcaaatctagccccactcaaactaatgtcaggttatctatgaatgaggctgggaatctacatttttaataagctttctagatgactctaaatgtgtactgtattatactttctaaaaacaatatttcattctagaatgcattttaatttctatgggcttacctttcatatatgtatatgattattttttaaaatacaagtgacttatttaattgtgctataatttgattccttatttacatatttgtgttattttaaatatttcatttagatttaggaaacaagtatttttcccacccattttcttatgagttaccttgcgtaaagcttctactgagtttaatgaagaatttaagtttctaaagattgtatcagatctcttatcttcttgtttccaagaaaatagccctgtcttccaaatcctctgatttgtacattatcagtgaaagacattttacttttgcaa

SEQ ID NO: 960 - DNA, 2194 bp, Homo sapiens
gaaaatcctaaggaacattttatttttcaatttcatttatttcatttttgtttatactttagtatgcaaggaacattttaattttttcttattttttgagaggaaaattacatgctcattttattcatgtctctaaatgcaaaggcccaaacaaataaaaattaagaaattaaatccaagaaaataaaaagaaagaaatgcaacgaaaatttaacatttgaaaatatttttaattaactctattaatagagaaaaactattttacctttttaataggatcagaaaacacatttaatataatgtagtacctattcatgattactggaaaaaacaaacatataaacctcaatgtattaggttaacttccacatcctgttaaataatatgtagtgaaactggataggcaaacaaaaaacaaaaaatagaactctacagtaaacattatctttaacaaaattgggtcaatttcagaatgataccgtaagccttgaagctattcccagcaaaatggacttataatttccacttttgctcaggcttgtttgaaatatgtttccatcacttgcatcccaaataatgctcacaaaacacaagactccttagctattgccagtacattacaattaaatggaagatgtacattttctcccatgcaggttgtgtgactaactaaaaatgccaagtttattaggtgttgctggagtcatatcaacttagtgtatcaaccttgccttatttcagatgttctgagtgtcagttatatttgtatttcataaaaagaaagataaagccaaaatcattactgcctaagatgtgctgttttcttgctagacagaatcattcacaacctgagatcagtggggaaatacaatgcaatgagtcctgggtgctgaaaatgtcaactctttggatgtaattaaatggatctgtgagtgtagtatagacagaatctgagacagaatttgatcatttctcaagttccctcttttacagttttgaattgtaacttgcgtaccaagcgtgagcttgactatgaggtctcaaagttttgaaccttgtgttctgaattttctttagctttctaagtgaggatgtttcctgagccatatggaactacatagctccaccagggtcctcaaactatagacctctccccagagcctaggctatcaatttggctgttttgtcttctcccacacagtctgaggttttcttagtcaccaaagaattttttttggacgtatgacagaactaagtcctataaaaaggctttggtgttaccaagattatggaattcccttcttagtataattaataaaaacagtagtaatatataaaacaaatgtaagaaatccccctgccccccaccacaaattcttatttctcccatgctatttgaatgttttaaaaacattgggtattcaattctctcaaaaatattttgtgtttttgcttctcaggaagcctattttatggaccatctggcagtgaatgcagttaatccaggcaacacttccctattttctttttctttttcttttttttttttgagatggagtctcactctgtccccaggctggagtgcagtggtgcgatcttggctcactgcaacctccgcctcccagattcaggtgattctcctgcctcagcctcccgagtagctgggactgcaggtgcgtgccaccacacccggctaattttttgtatttttagtaaatacagggtttcacatgttggccaggatggtctcaatctcttgaccttgtgatttgcctgccttggcctcccaaagtgctgggattacaggcgtgagccactgctcctggcccacttctctattttcttttgttcctatctacctggaaaacactgaaaccaattcatgtaaaaatttggccaccagcctaaggtaccagctctacattcttatctgtggtgtttccatcatataagctttcctgcttattttcatcctcatgttgcaggaacaggactgtttgttccctgactctttccttccagaaacttttcacatggtgtctagatagaacatcaattgagtggttaaggaactattctacatccacatctatatcctctttactggatgttctcttcatcagttacctttccagagacctggctcttccatgggaagaggtttctacttatttttttcaagtgggggatgttg

SEQ ID NO: 961 - DNA, 3728 bp, Homo sapiens
actccatcggtgcctttgggaagcgccgccttctctgttgtacccggccgtgggtcaggtcggcgcggctggcggtggagtctcggacaccgagccctggaccccgactctggaagcccccagccccactgggccgcggcagggcgcccaccctccacaatctcagttcccagccggggagtgaggggctgggcgggtctctccaccgctttggagacctcaggacttggatacgcttttgagtggtcccagtcgtcctgatccacgaaggcgtggagtggaagtcaggaccaggggtcgccccagtgacgcaggaagtcaagcccagatgcggtgaggcgtcgccagccttggacccagcagtgggcgctggtgacagtggcgacctcgccgatgagagggtcttgctctgctgctgacactggccttgagctgctggtctcaagcgatcctccagcctcagcctcctgagttgggattacaggcacaagccacagtgctcgactttttatttaatcttgttagaagacaagacagaaacatgtccgttgtgaaaacaaggaagctgcgggcagatcgattgaccccaggagttcaagaccattctgggcaacatagcaagactctatctctgaagacaaaaccagccaaccaaccaaccaaccaatcaaccaacaaaaaagatcaagcagaggtgctccagaggacgcagcaatagaattccggagcaatgtctgcttggcctcggtcttcattcccatggtggcccctgagttccgtggagctcacttctacatagttccatgtgtgacttcaacaaaataaaatgacgcatttattggttaaaaatcagagattaccatcagatatggaaaattgcttttacttggtaataacaatcttacgcactttttaccaaacccatcgcattaaataactagcgtttcaaattttgacactgcataataaaccctcatttgaaatgactggagaaatactcatcaaatctcatggaagaatgacagaattttctccagaatttatcggaaaggaaaagaggttggactgtcaggaaacgttttcagggtaacatacttactattttctagacagttactcagataacacttgtacgcagagggaaacacacccctgggctttgcaaacacttgtttcctgtgtgtcagactcgcctgcatcctgtttatcaaatggaacggatagttattgaaagcaaagaccagaacaacttacctcttgtcagtcacctgcttttctttacttgtcatacttttagcatttacaaagttttaaaaatgtgtttatcatttggtaattatttttaaactttatttgaaaatatagactgagttctgaacaaattatccttaaatttcttcctctagtagttacacttttcagtatcagtgaagttttatgacgcctctatttttcctacccacacagcatctcaagtttgtctttacagaataactggaagtcctagctttatcctctctctgcgtttctctctcacagccccctcctcttggactctgctcttcctctcagcaccgtaacctttttaatttccagataggttttgaaaacaccatctgttcccctcttaggatccctggggcagatgataggtgaaccccacatcccagacacatggccaccaaagatattcttgcttttttaatgtttatcaagttcctccgcagacaacagaaaaaagtgatccgctgccagcgacagggagacacacaactggtccttattctaaagacccgacccagcctggaatggggcccggcgaggagttcttgcgccggccgcggggactgggcggtaatgagccgctagtctcggaaggtggtgctgttgggtgtgaggggagatccggcttgcgctgaaacagcgagcggcgtgcaaggaggaagccgcgatttccaaggcggattcccttcgctgggacacaactcttgagaataagacttataaggactctgagagtttgaggcagaggcagaacggctctgggctgagtgatggggaggataccagcactcagcgcgggtggcgggcgcggggccgagcgcgcgcatccagggacgccttggggacgggacgcggagaaaagttgccgggcggagagaaagggtggcgctggaaaccaaatggctttcatcccctggagacaaagaggtgccttcttttgacaacagctgccagtgacacacacaccatacggcggggccggcgggggaggggagcccgggaggagagcgtctaaggcggggaccggcactgactttcaataatggggtggttgccatggtgacgggccaggcatctaaaggggcggctgaaagcacccattgttctggggcccggctgctcgggttgtgcctgttcctaagagacacctttagacacctccctccgtgcaggggcgagctgcggcccggggctgggagcgtctccgcgggagtttcacaccagggccccaggccgcagatcgcagcgccgccttggctgcacgcgcgctgcatacggagggcagcgccgcctcccacgcactatccgcccgaaatccgagcgcgacgcgcgcccgcctgggcccagacgcgcaggccgggacacgcagctccgcctgctccccgctgtcccggggagacttcgaataacaatgcggagcaggacccggtgactccacaaataactcgctgaggtctggggcgagggcactcgggaaaaccccgcagtcactttgcagtcgtgctggaaggaaaagcagaacggaatcacaggataaagaagattaaaagtaacagggcagcgttgcaatgttgcttgtaagagcaagcagctggaaacaacctaaaagcccgtccctgggggctgggtgaatgatatggggcgcatccctctgagggaacactaagctgccattaaagagtacagggcagctgtatttgctgagacgtggaaattttccggtgtattctaagtaataaagtgcagaagagtgtgagtagggctgtgtgtatgtggtatgtgtgtttgcatctctggaagtggttgcttcttaggatggtcactgtgggactaggagtggaggagagaaagaaaacttgcttttcaccgtactagaatcttctgcaccttttgaattttgccgtttatactatgtctttacctgtaaagaaaaaagaactttgaaataaagttgcatttgcttgaacactgtctaatgagatgtgccactctccataaagcatctgaactcatttttagtgctttaataaatattaatttttaaaatatatatgcacaaatgctattagcccacagatatgtaaaggtagtgacagtggcaagttagagatgaaaagatacacttctttcctgccttcctgtggtgccgagacggacggagccagctgtcattcaaggagcctgctgtataacccatctattattatatcacattaatcatagggatctcacattaaacaaacatgacattagggaaattttcctagttacaaaatggtatataatcagtgaaatggactattgaacaccaaatgtcatagattttttttttttttttgagacgagtcaagctctgttacccaggctgcagtgcagtggtgcgatctcggctcactgcaagctccgcctccctggttcaagtgattttgctgcctcagcctccg

SEQ ID NO: 962 - DNA, 1681 bp, Homo sapiens
gaattagcataggtttcctccgcaactgatgcatcttctaaccaggctgggaacacaacacgcgcacacgcgcacacacacacgcacgcacccaccccacccggctgccggacgcaagcgtaagtcaaggacttgcatgctagaatcagacagaaaatccagaaaagccacgttatttaacagaaccctacaaggtcagctttgagtcaaagcaggtaacagtttccttcgatgttttcatggacatttttattcccaaatccgagttctcgccaattctctaaagttcaagcgcccctcctgctttgcagaccacatttctctcggccctcgcgagtgaggtcgccaaatactcgacgcctcaagagcgagccgaggaggcagaggccgaccaagccggcctctcggcagccccgcccggcgccccgcggagaacgcccgggtgcggctcgagggaagttgtgtcaagtcccacgcgcggcccgcggagaacccaggggcggcccgcgcgcgtcggcctagcggggagggctgctccgggacacggtgcggcggccgcgggcgagttggacgcgctggcagagccgggccgaaggcggcgggcgtctccgggcagccatgttcgcggcgcccgcccgcgcagcaggacggagccctgacagcaatgtttgctacggcctccctctgcagtcagcctaaagcaaggagctggaggtagatgaggcaaaggtaaaggagaccaaaacagtattttaaagaaaaaatcatttatcttcaaataggctccaaacctaagatggtgtatactgttagaggacaagaacctgcttctagccatctttgcgtctccaggacctgacttgtgaccattcaataagagtttgatagatggacagactaatgaatagatgaagatgattagaagccaaaatttctgaatcttcctagcacccagaacatggcttaacatcaaggaaatgctcactaaatactgtcataatggaatgaatggaaccgatgcctaattgaaaatcattaggctgtaaaccatttccatgttccaatttcttcgtttatagaacagaaatgatagtgtaaccacctgaaaatccttcacctagacttccaaaaccacacccacctcatcaatgaagtctgactctctagaaagaagcaaatgactgaaatcatggtcctgtgccttgaccaaaataccattcgtcagaacaaaagaagtaggtcagtgaaacggcattagtatatccttcaacaggcaaataagtgatagtgtagtttgcttttgaagtcgctgtgaaaagttttaggtgaacatcacctacaccacattaaaaatggaatcaagtcattttctttaagaaatggagtttgagatatgagaattcttttgggctttttctacttattggccaattatacacccagatatatttctgcaatatttcaaagattctagttctaatttgtataataaaaaaaattaacagccttttccagaccacatgtttccaacaagaccttcaaaggcctcgctcgctatataaaactggctttaaacaatttcctttcccaaagaaggaaataagatatttcggttttgtaaaagaggcaaaaccaggtacaggccacctttcctgctggagagctggcataagtgagtgga

SEQ ID NO: 963 - DNA, 3009 bp, Homo sapiens
gaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaaaaaaaaaccacaacaacaacaacaaaaattccatgttgacaaggatgggaatatgagaacatggaaacagctatgaaaagacataagagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaa

SEQ ID NO: 964 - DNA, 1991 bp, Homo sapiens
tgaataatatgccaactttcctctttcctctataatcaacttcaatgaatatttctgtacatgtatccttgtgctcatgtcaaaaaaagcatttatgattatccttatgagtaaaattgctgcttctaagggtctaaacatcattatgaaatattgtaatattgctctccaaataaatcataccaatttattgtctaaacaccagtgtatgaccatcactacagctttacatcccccatcagatctggtattgttgggttatgttttgttttggtgaattcccaatatttttaattgggaatctcattcttgttttcatctgcatgaaattgtgaggttgagtatgttttcatttgttaaaattagatgttcatgtttcctctaatgtgaatcatctttttgcacactttagtaatttttgtatttgtttgctgtcaactttcttattaatttgtagaagtttctttttatgcaaccaaatcttttataagtttgtaggcattgtaaatatcttctctcaggatatggcttttaattcactttatttgtgaaataatatttttgttgtctagagaaattttaaatcatatcattttttcaaggtttgtattttttttcttttgttttgaaggtttatttttcatagataggtcattactccatttggaactttttaatatatgagtagatatctaattttattgtatacaaacagctaatcgctccaataacagcaaagagttcatcttttctactgatttgtattgctacttttgccagccatccacttttcatagatttatggatctgtttccaagcttactctcctattctgttgctcaatatttttgtataaacaattcccttcaaatattcctgacagcttatttcctcttgaatgttattctggtctggtccccttaaacagctgcaatttattgatggaacataaaacaggcaaaaggaaggagcaagacacagagttaatttaatatcctgataaaatagatcagcctttagtattttaacagctatatattatttatttagtaattttggttttgtttgtaaacaagcaagttatattgtggtaaagaagaaatatgggagtcaaaataagactttaaagatgtatctaattttgtaattaaaatacatttcctactcaacatttttttaattttatgtaaaatattttaggctacactgtgcatgttttaaaaccacttgattttaaagctttttaatagaagaaaaaagatacaaagctgaagttgtaagggtaagtgttaagtattgaagttttgtgggcctaacaaatgactggtttatataatttgtagaatacttttttattttacatacttacctaatataagtggtgcctaaataagtaatgctttataggacgaattgatgcaggtgggagagtcactgtgatatgagactgtcagaggcctttgaaccagagcaattctattgtgaataggggctggataaagtaagtctgagacctacagggctgcattcccaggaggttaggcattcttagtcaaaggaagacacaggaggtagctcaagacacaagtcacaaagaccttgatcataaaacaggtcgtggtaaagaagccagccaaaacccaccaaaaccaagatgtcaaggaaagtgatctctggccttcctcactgctcattatatgctaattataatgcattagcatactaaaagaccccaccagcaccatgacagtttacaaatgccatggaaatgtctggaagttaccctatgtgataaaaaaagggaaggaactctcagttctgggaattacccgcctctttcccaggaaactcatgaataatccaccccttgttgagatataattgataaataactataagcatactaagtcaagtagcccatgccactgctctatctatggagtagccattgttttattcctttactttcttaataaacttgctttcacttt

SEQ ID NO: 965 - DNA, 3864 bp, Homo sapiens
taaactgtctccagataagaaagttctagagcaactatcctatatttttgaagaaaaaacaattctatctggggaagttttattcttcagaaagaaaaacttacggaatgggaaaatcaaccctatctaaatcaaccctgactagtcaacccaagtcaactctgagtatctctgaggtgaaagatgaagcatgctgatgggtgtcaaatccaatcttgtatgaataaaataagcatcggggaagcatagatgtcatcttctaaggcaaacattctgaggatctggcagcataaatccatcagttaatttataatataattggacaccactatggccaaagtaaaagacacggccaaatctggatcaccttacaattttcaagatgctttcaagatcccccttgtcctgttatggctgagggaagcagtgatgggagtaggcaccatagtctgtaacccctccccttctgtctcggtacagacaaagcagataagctggggctctggtaatcttacacagtttacttcatgccaatttttatgctccatgagatccaggtaaactgagaatgctgtgcatctcctacatctaactacatcatttctaaatacttagaaatattttaagttttaatacttagaagtattttaagttaccgtaaagactttgaaactgtgacacaggtaccctcccctctgatgtttttcctagtcatcctgggtctcaggtagccacatggcacccaagatgggtatgaagggcaggtcctgtctgagtcctgaatttacgcacagctgtagacctcatgacagaagacagaaatgggaagacattgcctggaggacggaaccctcccaaaatagccaggaggcaaagctagggcaggggaaaaggggatatattgggcttgattctgccttgcagctggtggcctaggcattgagaatgtgtcctcatgcctcactgtgggcatacatccagacctctgactccagaggctcaaaaccaaaaacaagcaagcaagtatcaaattatatttaactgataattttgaagccatttctattttagtaacaatttacaactacctttatttactaaatattacatacaagtaacacatatagacacagacacaaagacagaagcagatattatagcttacataaaggattgtcatttgctggcttttgaatagtttttcttttccccattcagactatcattcttccattacctgtttcattgccctaaggagttgttagctaggcaaccttaaatttgcatttctaatgggacaactcttaggtgaaataaggtagaaaatttatatctcaaaagcacaacctaagactttaggcgtacatattgtaccctcatttgctcaaaccaaggaaaaaatgatgtgagtaaaaaatttcagttaagatgtccagaaaagcaccttaaacaaaggtttgacttgttacataaatttaaaactatggtaaaagtttctaatatacacaggcagacacccttacaaatggagatttcctttatagatgtaaatttcttttacagaagagtttcaggatagccagttaaatgccaggaaggtatattttagttgggtaggtggtttatttgacttagctactgtttcttggctaaaattactgagttcagggtagatggagcccattgaggaatagggcaaagaaaacagtactctgtgcttggactcagactggatagatctaaaaaagaagcaagtctgctttacccactggtttacattttatcaacattttatccaggatatcgttattttcactcttgaggcaggatagtgtttatgccaaaagtttagcagatttaattattcttgtgaattattcacctgagctttttatttgccttttttttttttttttttaaagacagggtttccctctgtgtaatcacaaaggcacagtcacagctgatttgcagcctttacctcctgggctcaagtgaatttcccacctcagcctcctgagtagctggaactacaggtgtacaccaccacatccagctgatttttaattttttgtagagaggagatctcactatgttgcataggcttgtcttgaactgctgtgctcaagcgatcttcctgctttgatctcccaacgtgttgggattacaggcatgagccaccacacctggccctatttgccttttatgaagtcttttaataaagcaataaaaatattgaaatgtttttagaagcttctgcacatcaataggcatccttgaagactaattcaggacccctcatttttaagtgctgtgttgttcattaggaacggtccattgtaattttaagttacaaagattttgccatttctgtaagtagttatttcttctgaggcctaatatttatacattctaccttatagctagaaggtagaatacggtgttcttcagatactaaggatccaatatttccctagaatcctggatttggtcctcagatccccttcatcaatttagttaatgatttttccctacctaagggtacaagaaaaagaatgtagaacacaaaaatctctgcaaatttctgaagtctgcacccactgtaatattaccatttctgctagtttctgcctgatcctggacatctgcagcctcttaactgaatccaagtcagttaattatcagatccaatccaatcatggatccagtccagtttctgttgtgacttccaaacccagttcggatcagaagtttgctcaaactcggttccaaacagaaatctgtcgagcttcagaatctcagcgagaacttaccacgatatcagttgcttccagaaagcaatggacatcgtgagtctgaggggtaccttgcttggtcactccatgctcctgggcatgacatctgttgaaaaccttagacatattaaatttaacagagtttaactgagcaaagaatgattcacaaattgggtagcccaggaaccagaataggttcagagaggctctggtgcagtcccatgattgaagatttatggacacaaaaaggaaagtgatgtacagaaaacagagatgaggtacagaaacagccagatttgttacagttcgggcatttggagtatttgaacatagtttgaacagttggctgcctttgattgactgaaactcggtaattagcacaaaagtaggttacgatctgtttatacatctagttaagtttcagttcactgtgtacagagaaacctttaggccaaacttaaaatatgtaaggaggtggctttaggttagacttaatttaacagatgttatatatattggttttcatccactgttcctgtcttgtaactcccatagcccttgttaaagtctttttgttacaatgttgggtgtgtcaggtctcatgtgtctagacttaatttaacaaatgttacatatattggttttcatccattgttcctggcttgtaactcccatagcccttgttaaagtctttttgttacaatgttgggtgtgtcaggtctcatgggcaggcctcaggaaacagaatttctcagactttctcctatccatctctcatctgccccaagacaagaccctataatcttccctgcctttctgattgggagttataagaccctcctcagagggcgtcccaccctatccttggaggaaggaatgctgatattttgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgt

SEQ ID NO: 966 - DNA, 6098 bp, Homo sapiens
cccagcccaggcaggaggtgcactggcctcccggcggccttttgaggcctaagagctccaagccctgcccttcgtgccctctgcactagacgcgtggccacagccgacagtggatacctcatggcgactcagagtcctctctttaacctctcagctaccttcttctcatgacgttttctcggtaaaataagtggtgtggctcccctctcctgaccgggctgtgtcccaggacagagccggctggaaacgccccgcttgactggagagcactgcccgggctgctgcaggtgcccctttcacaggagctggagcgcgcctcaatgcagagatggtgtggctgggagggacttccctttcccagtcctccacttacatcacagggcacaagagccattggaaaagcatttagagaaatcatagcgaaaattttccagatgtggcaaaagacatacagctgcagatttaaaaagttaagcaaacctcaagaatcgtaaacccaaagaagttcatgccaatcacatcataattaaacatcaaaaaaaaaaaaggcagaataaattttgaaagcagctggagagaaatcaaatgttgttcatgaggcaacaccaattcaagtcagctgagctttcacctgaaaccataggacgcagaagggagtgactggtttttaaagtactgagggaaaagaactgtcaactgtagattcaatatgtggcaaaattcctccaaggagtgaaaggaataagtacttagcaaacaaaggaaaactaagaaaatttgttgtatctttaaagagtacctaaaagaaattcgctaaaaggaaaggaaatcaacaacaacaaaaggacttggaactttagaaagaaaaggaaaacattaaagtagattttagaaattaggaaagatataataaatatccttcaattcatgagttgccaaattcatatttgatggttaaagcaaaagttatatgaccatctgatacagttctctttttatgtagtgaaaacacttaagctcactatacataaaaagtgggaagaataaaaagacctgaatgacagtaaggtaagatgaaagtagaaggaaggaaaaagatgtattaatgcagacattaattaaagtaggagtggctatattaatataaagtagacttcagatgaaagaaaattgcaagtcaaagagcaacattaaataatgtaaaaggatcaatccatgaggaagatgttgtgatcctaaatgtgtatgctgcagacaacagagccttaaaatatatgaagcaaaaacagagttgataggagagagaaacaattccacaattataggtgggaagtttaacatctgactctcagcagctaatagagctactagacaatcagcaagaatacagaagactgagcaaggccatcaacccacaggatgtaactgacatatagagaacactcccaccaacagcagcagagtacacattttccaagggccgtggaacattcaccaacccatattctgggtgattaagcgagcctcaagcagtttaaaataattgaaaccatacagagtgagctctttaaccgtaatgaaatcaaattagaaatcaataaaataaaaacaacagaaaatatccaaatacttgaaaattaaaagacttctaaatatttcatatatcaaagaggaagtctcaaaggaaattttaaaaatacatagaatgggaagaaaatgaaaatatctcaaaatatgtagggggaaaaaactagagctgtgaggaaatttttagcactaaaaacagaaaatgtctcaaatcaataacctaagtaattcaagtaactagaagaaaaaagagcaaaggaaggaaatcataaagataaaagcagaaattaatgattttttaaaaaaaatgaaaaggtaaccagcagcttaactccataatgcattttaaaactttttttccattttagtctcaagatgtaatcttgaagcaaactgcaacagccttttcccttaaccttaaaatagactgcatgttccttcctttcccactgtgtactcccttcacattcatctaattatgccagtatctaagtatgtgcttacttaggagttcaagggctaaccttgagacagatagaccgagcctagagaccgagcagaattccagagattacctcaaggcagctagtcaccaacccagccattgttcagatgatgtcagcccacactccaggtagacagagatccaagatagccagtgaaaaaggacacacacaccttgcactcaacacaactgcatgtgtcccatacgaagtttctctttataaaccctagccttctccctacaagttcaatgtgattcctttggatatgaatccagccacttccctactgctagtttttgttaatgaagtcactttccttttaccagacctcactcattcttaagacttcgcaagcagcaaacagctggacctgcattcatttacaaaaatagaaaaaaatgaatgaggcaaaacactgtctgtttgaaagaaaatcagtaaaatgcataaacctctagtaacactggccaaaaaaaaagacacataaaaattagaaatgaaaaaaaggaaatcactatgaatcctttggccattagaagaaaaataaaggatatgatgtataactttaaactcacacagtcaacaactgaaaagaaaagaaaaaagtccttgaaaacctaaaactaccaaacctcaatcaagataaaacagacaatctgggcagttctgtaatcttcaaagaaattgaatttgtaaataaaagtttccacaaaaagagatctccaagtctggatagttgtattgaagatttctaccataaatttaaagaagaattaacaccaattttacacattctcctacagaaatagaagaagcaaaacacttccctactaattttatgaggtcagtattacccttataacaagcctacaaaagacaatacaatgatttatatcactcatcaatttagaagcagatattctcaacaaaatattaacaaattgaatccagcaatgtatacaaagaattctacaccataaccaggtggggtttattccaggtatgtaaggctggttcaacatttgaaatcaatcaatgtaatccatcataagttaaatttaaaactttgcgtgatcttaacaattgacacacaaaaaaagcatttaccaagatctgtgataaaaataaaaaagaagggaactttcttggcttaataaagagcatctacaaaaaaccttcagctaatatacttagcattaaaggaatgcttgcttttcctttaagattgggaacaaagcaataatatccactgttatgactctattcatcatactactggaggaagttttagccactgcaataaaacaaggaaaataaataacatatacagatcaaaaaggaagaaataaaaccggacctgcttgtaggtagcatgattgtctacatagatatagatctatgtagaccaaaaaaaaaaaaaaatagaatcctagaactaataagcatgagggctttcttaaactcagatcaatgcataaaaatcaactttatttctgtataccgacaatgaatatgtagaaactaaaattaaacataacagtttacaattgttccaaagaaaatgaaatagggataagtctaacaaattgtatacagaatctgtatgctgaaaactttgaaatgccgatgaaatgaattttttaaagtcctaagtaaatagggaaacatactgtatttatgagttggatgactcaacatagaaaagttgtccattcttcccaaattgatctacagatataatccaattcctacaaaaatcccagcaagggattttgtagacatagaacaccttatcccaaaatgtatctggaaagcaccaggccctagaatagctaaaaaaaaaaaaaaaaaaaaaaaaaaaaaaaaaaaatctgtactaagaacagaatgggaggaattattctacgtggtattagatttgctatgtaatcatagcaatcaagacactgtggcattgaaaatgcaatagacatattgataaatggaacaaaacagagaacccagaaatagacctacacaaatatgcccaactgagttttttataaagatacaaaagcaattcaatggaagaaggaaaatcttttcaacaaacagtgctggaggaatttaacatcgataggcacaataatgaacacaacctaagtctcacagctcataaaaaattaatcaaaatagatacaaacataaatgtgagacataaactttaaaacttttagaaaaaaatagaaagaatcttcaggatctaagatttcttaaactttacaccaaaagcatgatccataaaaggaaaaactaataaatttaacgttatcaaaattaaaaaattttacttagtgaaagatcccattaaaagaatgaaaagacaagctatagactggggaaaatgtttgcaaatgccactaccaatgaagaattagtatctagaattaagaaaaaaaaactcttaaaatttaatagtaaaaaaatccggtaacatgagcaaaagacatgcacagaaatttcgctgaagaggagatacagctgtggaaaataaacacatgaaaagatgttcagcaccactagctattagggaagtgcaaattaaaatcataatgagatatcactacacatcagtcaaaatggctaaaattttaaagatagtgacaccaccaaatgcaggcatgaatatgaagaatacagatcatttatatatcactggtggaactatgaaatggtacagccaggttggaaaacagtttggcactctcttagaaaattatgtatgcaattactgtacaacttagcaatatcactctttagtatttattccaaagacagaaaaacccatatcaaaaaaaaatctgtacacgaatgttcacagcagctttatttgtaatagacaaagactggaatcagttcaggtatccttcaacagatggaaaattaaaaatatgattcatcctttccttggaaaactagtcggcaacggaaaagaacaaagtgttgatagacacaacttagataaatacctagggaattatgctaattttttaagaaagccaatttcggctgggcatggtggttcatgcctgtaatctcagcactttgggaggctgaggtaggcagatcacgaggtcaagagttcaagaacagcctgaccaagatggtgaaaccccatctctactaaaaacacataattagcagagcatgatggcgcacgcctgtagtcccagctactcgggaggcagaggcaggagaatcacttgaatccgggaggcagaggctgcagtgagcccagattgtgcccttgcactccagcctgggagacagagcaagatttgtctcaaaaaaaaagaggaagccaatttcaaaagattccatattgtttcctgtatataagatttttgaaaggatgaaacattaaatattgagaaatgattggatggtttctaagaattatggatgatgagtggagtgagcaatgagggagaggaaaggggaagaaaggaagggatgatgaatgtgcttataagagtgcaacccggggtgggcgtggtggttcacgcctgtaatctcagcactttgggaggccagggcaggcagatcacctgaggtcaggagttcgagaccagcccggccaacatggtgaaactccatctctactaaaaacacaaaaattagccaagcgtggtagcacacacttgcgatcctaactactcagaaggctgaggcagaaggattgcttgaacccaggaagcagaggttgcagtgagcctaggtcatgccactgtattccagcctaagcgatagagtgagacaccatcttaaaaaaaacatatatatatgtatatatgtagaagagagagagagagagagaacaacacaggatccttgtgatgatgagtggtggaactgtcctattatctttacttcagtgaagtaaatatacatgagcaggtatatctatacatgaatctacacgtgtgataaattttatagaaccaaatacacaaaaaatgaatgcaa

SEQ ID NO: 967 - DNA, 10941 bp, Homo sapiens
aatcaagtagccggcttgccttgcggaggatcctgcttccccctcctccaccccatttttttcctttcacccagtaaaaccctgtttaactcacccttcaaaccgtctgcgaggctacgttttcgtggccacgggacggacaaggaccccatctttagctgaactacggaaaagccctgcaacaccaccatctcatcgctgacttggaaataagctagcagtggctgtgtcagcaagaccaccacatgcagcaagggtggccacttccagctagctcctgcatccacagctgcctcgcccctattggctactgccatccatgtaacagactcttgggaaatatgctcggctgaaaaactgcatttcccaactcaagacctaagaggtggtcaggagatacaagcaggagtccttggatgaggtaatgagaaaagtcatcatgctctagtccttcctctttcttgcctcttgcaaatggaatgactggaacacagcagccatcttgagatgctgagaatggaaaccacacattaaaaatagaaagagggccaggcatggtgactcacacctgtagtcccagcactttgggaggctgaggcaggcggatcccttgagcctagaagtttgagaccagcctgggaaacatgggagatctcatctctactacaaatacaaatacaaaaaaaaaaaaaaaaattagctgggtttggcggcatgtacctgtatagtcccagctactcgggaggctgaagtaggagaatcacctgagccggggaggtcaaggttgcagtgagctgtgattgcaccactgcactccagcctgggtgacaggagtcagaacttgtcaaaaaaaaaaaaaaaaaaaaaaaaaaagatggaagggcctgggttcctgttgacatcagggagccaccttaccgggcctgggttgcttttctccagatatttttatttttaatgagagaaggaaataaactttttctttttgaactgcttatttgactgtagctgtaaatacaaagctctagaatctctgtggtaatgacttttaaaagccatcaagtataagccctgcaccatgtcaatgagagataaagggaagcaacaagaaagggaaaggagagggaaagagaacgaaacagagacagtgcttgatccagggccagaccacctgagtttggaccctagtctatcacctccctactaactgaccctgggcaaactacctaagcttcacagcaccctcggttctctaacctacaacatggggatgccaatggcagtgacctcagtgtatggtgagagttccatctgttaccatgtgtctgtctcgcggtaaacattcaacggcagtcaggtgctctcccgctttgaggctgcctggcagcaggctcctgtctcctagggttgaccgttttctttggagtagactttcactctatcggaaagctgttcctcgggatgaataaacactgcattcccatcacttttggggcctgtctagatctgtttcccagagccatcatgtgcaagactaatttcgctctccatatgaaaagtcttcaagtatttgaagactggctggccatcctgcacaccctgaatcttcactcctctggctgcgcatctggagtgacggagcccctccctcgctgtgcttcagcttgttccttcccttcttcagtgggactccaaggaacgaaggtcatattgcaagtacacttctgtttttgtggccatcctctgatacaaccatgttcggcaggagtcacttggcaactttcagctggtggatggactgatctggaggatctgagattgtttcactcacatgcccagtgccttgcaaggctggctgaagggctgggatcagtggggcctgggaggcagagagctcacctacagcgtctccagcgtggcaaccccagggcatcagaacttctcacgtggcacctcaggactccaggagcgactgctgccacaatccaggaggcactgtatggcctctgtgacttggcctcagaagtcacaccatgtcacaacctttgcactttgttggccgaggcagtcacaaggctgcccagattcaaggagaggagacatagactctacctcttagatggaagaggcatcaaagaatttgcagccatttttaaaacagccagttttctttgactgcatgcttttattttcccctgtaatcattctcagagtgagatctctatatagtaggtgctgtcaaatgacacgggggagtgtctttctcaggtctcttactgggaggtacagcactggtgtagatgggtctttcctccctgctgtgtgtagaaggctgtcacctgggctgcaccattctggatgccacactattactgacccagtctaagacatgattaacccctttggagacaatgtaacattgccgacccacatcaagctcactgtatactacagtctcagctcttcttcttgcttgcttggaagtacctgccctacctgtcagctgctagtgacccccgacccatgaacagtccataccacagtcttctcatgctcaacaccaagctcatttgatttcagttggtacatttttgttcttcctctttatgaggttcctcaaatccaggcctggggaaggcatctctctgctgctccatgaccgtccatgagtcatggagagtggccctgtgatctcagaggggttttcaaaaccagagtgtgtttgccaacaaaaatgatcaacattgattggagggctggagaaggagttatagagtctggaaagtgagccagctaaatcttcatcttcgaaaatggagaggttgtagataatgtctgaagttgacagagcaaggaaggacattctataaacatattactgtatttggagttatgcaggtagccactgaaaaactaagaacagaaatgcttcaaactggttgcctctggaaagagagctgggaggaagagtgggctgggagagaccagctctcctcatgcttagccgtgcagtgcaatgtagtattttaccttgtgcatggattttgtaataagaaatagcgatgtgcatttggatattaaaaacattacacaacaatttagagtgaggcgtgccatttaaaaggtctgattagaggttgcggtttgtcattacattttatagagggttgtcttcttgctttgggtttaagctctgttttcattattttaatttgttttttagaaaatcacaaaattgggacaaaaccaggagagagttgaagacaatgggggaagggggagaaaagctccccagtgaattcagctgccctttctgtaccactctatgtactttgattttatgtccttctggaaaaattaaattggaactccctttatcacttcttcatttcattttttttccgttgtaaaaagggcaagagcttaatgtgccacagagtaaagctgcaggggcagctgggcacacatgggcagatgcccgaggctctgggcagctggctgggtcttccactcagtttccaaagtacgcagtcgtggcagcagctggaacctggcaggcaggtgacaggaagacaagctaagggggtgcatatggcatttctgtcgggtttaatgttttaacaagtcagaggaatacttaaatatcaaaacgaagtatccctgcagtaaatatttatcctttaaccataaaaatatccttttataccctttgagaattgagaggagaggagaggagaggagaggaggggaggggaggggaggggaggggagaagaatggagaggaggggaggggatagaagaggggaggggaggggagtggaggggaggaaaggggagaggaggggaggggagtggaggggaggaaaggggagaggaggggaggggagtggaggggaggaaaggggagaggagggaaggggagaggaatggagaggagaggaggggaggggaggggaggggaggggaggggaggagagagattcttcagaggttgatccaagctactgaaagggttgttcattcactggcagcactggcctcacccgggagcttgttagaaatgtaacatcttcctgttcccctaagtggcctgacaatctgtggaaatgtgaactcaggcaaatcgagaggttcaaatcttcgtgttcattgaagaacacctgtgaaactgctcaggccgtcagggtatgcatatatcaagagccacccagtatctgaaagatgtcacttgacagagacagtgtgtaccattctgacgttacaaaggtggagttggtaggtgcgtccaggccaaacagtgggactggacacagggtcagtggcccaaaaagagtgctgaatgtttgctgcacatgcttaaaaatgcagagtcatgctgaacgtaagggtttacatgtagattctctggtcattgagcatagccaggtgaacaaagtacccaagatgtgtggccagactcacagagctcagggtcaggttaacccatgtgtgagctctgcctgccacagtgagatgagccttattgaaaaggaacaaattgttcctaaaccagaagaggctgcgcagaagaaaaagatagcccagaagaaactgaagaaatggaaacttacggcacaggaatagactcatccaacaataaatggaattaaaagtacaggaaggaaggaaggaaagaaagaaggaaggaaggaaggacagaaagaaggaaggaagaaaggacggaaggaaggaaggaaaaaagaaggaaggaagaaaaggaaagaaaagaaaagaaaagaaaatgtagcatctcaggctccccatcccatggcctcctgctcctaatctgcattttaacaagaagctcaggggattcatgtgcacagcagtttgagaggtgctattctaaggtatagatgaggaattcttagtcaagaaagtgcaagcttgtggttctcagctttagcttagaagcatgtggggcacctgaaaaatactgatgactgggtcccaccctagaataattaaaacaacctctgggggcggagcctaggcatggatgtgttttcaaagcacccaggtcatctcaatgtgcggccaaggcagaaaatatagggtaagtgatgcttagagctgctgagcacattctgtggcaacacccaggtggagaccctgtctccttcatgcgctgcctcctctgcgcttggcgacgtgaaggaaaactgtcatacacaggctcgcatcgaatcccacaactattcacaagatggtctaagtggggtgtctaatcttttggcttccctgagccacactgaaacaagaagaatcatcttggaccacacataaaatatacaaacactaaagatagctgataagctgaagaaaaaaaactgcaaaaaaaaaagtcataatgttttaagaaagtttacaaatttgtgttgagccacattcaaagccaccttgggcccatgggccatgggtttcacaaacttggtctaagacttcatccttgagttagagtaagcctcttgtcactggagaaataccttactgctgtaaactacatgaaacactcatgcatattacaaagtggaatattaaaatctgctgccctaagacattgaacagcttcagtgttatccagcaatgctttactcaaatgtggatggagagtttaactaaaaggaaagcatggacactgggaaaccaatcaatcagatttcctattttcataactgagagacaaaataaaataagggtcgacagaaggtgcacgtgtttgcaatacttttgcgagagcccattgccacagccaaatgttagcctcttgaggcataaattaatttaccacaaatgcatgcctggttgcgtctggattctgctagggcgagcagtatgtgttagacttttggacaacagcttaaagaatgacatttctccaacttgctgtgatttttatcctcgagcagaatgtttttcttggaatgggtttctgggagggtttgcggacataattctggttatgtgtgcgggccctgaagggtgcttttatgaatttagagcagcagctgtccaggcagagggatgctctttacccagagtgtgtgtgccccagtaaacatatgaatggctttcatggagctctccagacacgtggcttgcgccccctgtgcccggccttacctggtactgctgcccggtgcagaggatgaggtggtcgtagggcacgatctcgtccgtggaaagcacaacgtgcttggctgctcggtctatgccggtcattctacccaccacgacattaacccaggagcacagtgacatcagtgcataatctttatcattaaaacagtggctgcaaagagagaagctccgtaagtgacatctgagcagctgacagcgggcattaattagacatctggtgagctggttcaagtcccctagtgggctgagtccgtgctcttgctgtgagtttaccaggactgatactaggagatttttcgttatgaaacacttagttacaaattgacatcttcccattaaagctaaattgttccacctggcttaggtcagcccacaactgggagggtgggaggggtgtgtgtgtgtgtgtgtgtttatctgtatgtgtgtgtgtgtgaaatcactcatactatacctttcttctgcttctacttcagagtggttgtaaatttactttagctgttaaattggtgtattgaccacagcctcaatgggaatgagaaggaagaaagtgacattgttgaggattcccaaagccaggggtcagaatctttgaataccgagaacccttcctattcgctaatacttttcagtaatcactcattctgagaattagcgtatggcttcctgccaaaacaacaaaacccattttacttcaagaatatagcaattagggagttaggttcgcagcaagtacactccctggagactttgggattcacccttcagggcagaggtgattttctaggaacggagacttcgaccgccagcaggcccagggcggccattcatgccatggcttcagcgtgctgtggctgcactggcttccattttctgggctctcttggagtttgagcgctttcacgtagtatgataagagtgggtttcttgtggctttgggtttatttaaacagttttgtgagggttgtttccagaattttctgaaaggattgacctcaggtaaaccaccttttagtgattctgttctgaatactgagagtctaaggtaataggacattaagtgcttcttttaatttaggctgtatgattcttttcttccttttttctcttaacataaaaacactaacatttttatttattcatctatttattatttatttttagaaacaggatctcactatgttgcccaagctggtctcaaactcctgagctcaagtgatcctcctgcctcagcctcctgagtagctgggactggaggcacgcgccacttctatgcttggcagcacagtcctcttcaaaaagaaccctgccatggtctgtgctgctgacaagcctggactctgcatcctcctgctgtcttcagtttcctcacctcttaacacagggtggaactgaagcaagtaatttgcgaagaccattgatatagtttggctctgtgtccccactcaaatctcatcgtgtagctcccataattcccacgtgttgtgggagggacctggtgagaggtaaccgaatcatgggaacaggtctttcctatgctgttctcatgatagtgagtaagtctcaccagatctgatggttttaaaaataggagtttccctgcacaagctctctctttgcctgctgccatccatataagacgtgacttgttcctctttgccttccaccatgattgtgaggcctccccagccacgtggaactgaaagtccattaaacgtctttcttttgtaaattgcccagtcttgggtatgcttatgtttatcagcagcatgagaatggactaatacagtaaattggtaccagtagagtggggcgctgctgaaaagatacccaaaaatgcagaagcgactttggaactgggtaacaggcagaggttggaacagtttggagggctcagaagaagatgagaaaatgtgggaaagtttggaactccctagagacttgttgaatggctttggccaaaatgctgatagcgatatggacaataaagtccaggctgaggtggtctcagatggaaatgaggaacttgttgggaactggagtaaaggtggcacttgttatgttttagcaaagagattggtggcattttgcccctgccctagagatttgtggaactttgaacttgagagagataatttagggtatctggcagaagaaatttctaagcagcaaagcattcaagaggtgatgtgtgtgctgttaaaggcattcagttttataagggaagcagagcataaaagtttggaaaatttgcagcttgacaatgcaatagaaaagaaaatcccattttctgaggagaagttcaagccagctgcagaaatgtgcataagtaacaaggagccgaatgttaatccccaagacaatggaaaaaatgtctccagggcatgtcagagacagcagcccctcccatcataggcctggaggcccaggaggaaaaagtggttttgtgggttgagcccagggtccccatgctgggtgcagtgtagggacttggtgccctgcattccagacactccagccatggctgaaagaggctaatgtagagctcaggctatggcttcagtggatacaagcctcaaaccttggcagcctccatgtggtgttgaacctgtgagtacacagaagtcaagaattgaggtttgagaacctccacttagatgtcggaggatgtatggatatgcctggatgtccaggcagaagtttgccgcaggggcagggctctcatggaaaacttctgctagggcagtgtggaagggaaatgtggagtcagggcgcccacacagagtccctactggggcacttctagtggagctgtgagaagagggccaccctcctccagaccccagaatggtagatctaccagcagcttgcactgtatgtctggaaaagccacagtcactcaatgccagcccatgaaaacagccaggagggaggctgtaccctgcaaagccacaggggtggagctgcccaagaccataggaacccacctcttgcatcagcatgacctggatatgagacatggagccaaaggagatcattttgaagctttaggatttgactgccccactggatttcggacttgcatggagcctgtaacccctttgttttggccaatttctccaatttggaatggctgtatttacccaatgcctgtacccccactgtatctaggaggtagctaacttgcttttgattttacatggtcataggcagaagggacttgccctgtctcagatgagactttaggctgtggacttttgagttaatgctataatgatttaagactttggggggccaggcatggtggctcatacctgtaatcccagcactttgggaggccgaggcaggtggatcacgtgaggtcaggagtttgagaccagcctgaccaacatggtgaaaccctgtctccactaaaaatacaaaattagccaggtgtggtggcacatgcctgtaatcccagctacttggcaggctgaggcagaagaatcacttgaactggggaggtggaggttgcagtgagtcaagatcacaccattgcactccagcctgggcaacaagagtgaaactccatctcaaaaaaaagaaaaaaaaaaagacttgggggactgttgagaaggcatgatgggttttgaaatgtgaaggcataagatttgggaggggccaggggcagaatgatatggtttggctctgtgtctccacccaaatctcatcttgtagctcccataattcccatgtgttgtgggagggacctgttgggaggtaattgaatcatgggagcaggtctttcccatgctgttcttgtgatagtgaattagtctcacgagatctgatggttttaaaaataggaatttccctgcacgagctctctctttgcctgctgccgtccatgtaagacatgagttgttcctccttgccttccaccatgattgtgaggcctccccagccatgtggaactgtaagtccattaaacctctttcttttgtaaatggcccagtctcaggtatgtctttatcagcagcgtgagaacagactaatacaaccatatagctagtaagtctggaggcagggtttgaacccaggatgcctggctccagcatcctctcaccttacctctgcctgtactgtcctgtagatctcaaattgttcagagggatccaaaggtcatctaattcccattggctgacattagctttattacattcagatacacacagttactcaaatcaggataccaaaaagtgtcatctgcgaggaaattctagaggattcctttttaagagcaaaactgctttatatttgcatcaggctttccagagcccaaggcacattcataggcattcacatagagattaatcttctacacaatttatgctagggatagggaagagaccggtttttctgatccacatttcataggtaagaaaatcaaggttggaaatggtaagtaatttgttcaaggttacaaagctcataagcagtgccagctatgaaagaaagccaggcctgctggccctaggcagcgccctgctccaggcacccacaatactccctctaactagtcctacaggtaaagtgcacctaagtagagacttctgaagaactcacatgctcaaggctcactccgtgtttgcccatcaggatttaagatgctcttgctgcaaatccaccccctggttaaagtcagtaaaatttcatgggtgagctgatcttttcatagggttcatgctgatgagatttttttttctaaaatctcttcttag

SEQ ID NO: 968 - DNA, 1477 bp, Homo sapiens
aagaatttttttttctttaaatatcattcatcaaagacacatttaatcctgttagttctgcatgcgatttaaaaaaattgttctggtaatactctgttcaacactacaagtaattctgcatcaagagaaagctccaaatattctaacaaccattcagcatttccaatgatcttagatccacgcttggtgcgaaaactgaaaacgagagaaaggaaacgctgtggccaggtccatctgatactgtgaaatatttcttatcttgattttctcctggataagatcctggagcttggtgagaagtgtaatgtgtaggggttctaaaagccagaggccttgctaaatttagatttggttcttgcttatgtaattttccctgtgttttcaattatttatacaaatatattatttatatatgtctggaacttgtgcttttagcactcaataagcaggaataatttataggattacggagtgcttcctgtccttacctttcagagtatgttcttttgcattgttaattaattgttatatttcagccttcctttcccagcagtcttgtggtggtgcttaactagtcagagagataggatctatatttatcatcatatgcatgttccaaaatccaggttaattattttattagccattcctctagcctagctacccattgcggggagggggctgcgtgtcggtggcatgacccaacaggtcatgttccttaagtacagtgagagcctgctgaaagaggaagccagcttccaggcctaaatggaagttgcctgtgcttcaggtttcttttttgcctccactttccaaaaacaatctagttcttgacctatccttttctccaccctccctcaacaccttttttcctctgctgccttgcactggcctcaggcacctacccaggctcctgaccatgggtctggatttgggctactgctagagacgctgcctgatttttgcccttgtctctctacagtgctcccttccagttgttccccacgtctggccctccttttccttggttctcaccttgtcttggatttcagagattcaggccctgcaacacacaggactggatgacagctgctcagagtcaacctggcacataccccagagtggtgcttgcatgtaaggaggcctaggcactctgggaatcgaaggcctgaaagtggctccactggctgagggctgggcaaggtagcagcgcaacatctacttctgcctttttctccacagtctcctcagtattccctggagcaaatggagagaggtgttggttgtttccccctgaggctggagtatattgctgtctaatcataggtttcagaagagtaaatatagtgagatacataaactttccctctgtgaaaaggaggacagagatttacaaactgaggtgtgttttttggctactgtcatttaaaggcatgaggctggctgggtgcggtgcctcatgccagtaatcccagca

SEQ ID NO: 969 - DNA, 1799 bp, Homo sapiens
ccctggtgggctttgaacacctgagctcaaacgatgccttgacctctcaaagtgctgggattacaagtgtcagccactgcacctggccgacattttttatttgtttagagacaaggattccctgtaaagctgcaggggcacaatcgtggctctcactgcagcctcgaattcctgggctcagtgatcctcttgtcccagccacctgagtagctaggactacaggtgcaccccaccatgcctcctattttttgtgtttgtgtggagatgaagtgtgttgtctaggctggtctcaagtgatccttcagcctcagcctcctaaactgctgagattacaggcataagcttttttgataaaggaaaaactagtgagcatttcacattgtagaatccaaaaacatgaaagttaatcttttcctgtcaatttacagttttgtaaatgtacccaggtgaagagactggtctgttactgtagatagaaaagtaccaaaacaaagttttactttgttcagtatactgtcgaggcaactttctaaatgagagggtccaggttcttggttaaagaaggaacttagaattaacaaaatagtgacaaacatttgcggcagcgcgcctcagggcaccagctgcaggggtctgcccacagaccctgaccctgcgacagatgaataaagtacactgacacacagatagtctgttttgccagtccagctgagggtgtcccactgcttacagactccctggagagttctgaaaacagttgcaactaggcctcagtcagctagtgagacttgcatttattcaaaaagattaaggatggcttgagtcaacaccattagagggtaattgatattgtggacttcccaagtaaaaagcacttaaccccccgtggtacatccaagattagtcttaagatcatatgactaaacaaactaggtaaactactctgccttcctttattactactttaatttgtttaaaagtaaagatcaggttgccttcaaccatatctatcaccgaagctatgcaaacttctcggccttccaagaattgtatctgtctctgtaacaatctttaatgtttttcccaccagcctgattgaatcccaacacatattcagaacttaaggctagaacaagatgaggaagatatgacagcccgtgattttaagcaatctaaggaaacccatgcttgcaaagaattcaaatgacgtgagagctactaagataaaatgtggccatgcaccaagccttgacggcaatatttaatctcataacaattcttctttcctcctatataagaagcatggcagcgacactgtgcataaattaaggcaaactgttgttatgtgaaaatgttaatgaggtagattcctttggaatcattagtgtgaagagctggtttttgttttcccattgcctaggccctgactttagtagtgactgatgcagcttttctagtctaacaaccctctcccccaagtaattctttgatgccctgcccttcagcttcatcttttaccacttactattgggttttgccaccatttattttatcattcacttatctgttcctcttcctaagttacaaacgtttctgaagcaaaagaaaatgtatcactgtagagagtctaggacctttagtgttatttggtcgtttacttttcatacactgcagcttttactgttttgaaccttcattgctatagtaggtattgaaaaatactgaacgaccagaagtgatttgatttctcccttatctggtaaataattttttttttttttgagatggagttttgctct

SEQ ID NO: 970 - DNA, 2015 bp, Homo sapiens
gatgtcccggcctttccttgaaccagtagaccctaatgatgcaccagattattatggtgttattaaggaacctatggattgacctttgtaaagaagaaaaacatgttagaagaaaaatggaaaagaactctgcatgccctcagctcagatgccatctcctctgggagctcctctggcccctgccaaggctggatcagatgccctcagggcacacacgatgctgatccagggccatctgtggcccagactctgggtccctcatgcagccctcaccactgctcaggaggccacaggaacagaggaatcactggcccattttacagacgggaaagctggacccggagaagtgaagcaactttcctgactcacagtgggtgagggcctcccacactctttcccctgccccatgctgtttccaagggacttccacaggcacaggaagcaggctgagtgcatagcaggagtacagcgctgctgcccagggatggagcaggagggccagggagagagagacaggggtgcccctggtgcccacagagacaggtctgtaaagcccatgaacaaactctcagcagggcggggacgggtgaatggggctggggcccacaacccataccacaggcacctggtctacacaggtctgtaggcctgtgcagatacctggctccttgaccaaggagggtgataaggccccacctgaccccagagatttcgccacctggttaggtgggcaggaggatagtctctctggagctctgggtcatggactctcagaggtagggagtgagtcagcatggccaaaaggtggagacccagtcacccacggatgcttgggatgggcgagcctcctggggcgaagccttctagggtctagggtcccacatggtggtccccggagggctttctgttcttccaggccctgcagaggagaccaaggctcagctggcagctgtggggccagattctcctctttgcctaggggagagcccccgcagcaccccttgagagcccctggggacctgcctggggcacaccctggcccccaggaagcccggctctgggagcactgcagccaggatggaggaggcagtcttcagagaggcactgtctaggccagccctgtggggagggaaggccagatgggggaacctggaggggcttgtgaactggttcctgaccctagaaacccagcagaggtggactcgaagcccattctggggagaaggcaccggcaggcttctccgcctgaggtctgccctcctgagggtgccaggagagcacagccctgggaagactgtagcctgggctgtgacctgaggactaggaagcgtttatgacagacatggagaggcctaagtccctgctgaagcccagcatcacatcccattcctgagcaccaaaggccccaggccctgggtaagagaagcttcctaaagggcatcctgagggccccgccctgatcacctcttctttggagaatttcaggagggaggctggcatgggccagacaactggctggacagggaagaggtgggaatatctggacctcgcctgcctctcgccacactccccgcttccctcctcactgtagccaaagttctccctgtgctttccaccgacagttcatggcctgtgcgtgctattccttctgtctggaacgcccttttcccctttgcttcccctttctaattcgtcatttttcaggtctcaccttagaagtcacttcctccaggaagtccttcctgccttgtcctcctctgatctgggctggatgtaagcctctgtgcttccaggacgtcctgcctctcaccctcacccccggatggagttgctggttttcccacctgtctccctctcaccctcacccccggatggagttgctggcattcccacctatctcccctctcaccctcacccccggatggagttgctggcattcccacctatctcccctctcaccctcacccccggatggagttgctggctttccaacctatctccctctcaccctcacc

SEQ ID NO: 971 - DNA, 3184 bp, Homo sapiens
gagcgcaggcgtactgttgccaaacgctgtgttcgactgtcttcccgcgtggggcctcgccttctgaatcttcttaccctcggcttcctacccggttgctcactgttttcccccaactgggtgtgcgggtgtctgcgcccgcgccgcccaccgtggggtactcctggcatttcgcttccagagtgctggcgcccacaagagccggacgttaattcaggcctttaactttcactctgtacctccccacaaccagacgagggagatgcatctgggggtggaagattgtaccctgcgagagggctgtcactcttctcgtggttgcaccccaggcaggtggagccagctctcagcaaattgtcggcccccagtgcttggtcccggtgcacacaaaggaaactcaggctagttggaaactccaaatctgccttgctgtcctggacccccatgcaaagcagtggtgattccaggattctaacctaaccggctccaggtcacacagctgtaacaggcaccgtgtccgatttgttcttgatggtttgtttgcacagctcctggctctcctgacatgctgcacttcgtaaatattcagggcctcccgtatagtttgcttaatatatgtcttccctaggcgactgtgagctccacgagggcaaggaccttgtgttttgtttcacactgtgcccgcaagtgcctgttgaatacacatgggctcttcggtttttaactattactgaaaaatgtctgacattgaaatccatcccaagcccctaccttaggctcatatttcaggcttctagatattttcacttgaattttcttgtcaccaagcatgttaaaaactgaagtcacacccatcccctaccccccactcttgtactgtctctgtaattggcagtgtcaccacctattcattccccaaattacacctctgagaaccatccttgtctcttcctcttaccccgactccaaatataaataacttaccaagcctcgcagatttttacttcccaagtaattctggagacagtcttcctctgcctcctcactaatgctagccttgcttcccaggtctggatttctgtagctggctcttaatcagctttcctgtctccagtctcactccctccaatcagttctgctcactgctatctaaaatgcaaatccaattcctggcgctcaggcctctgcttcaaccatctcattgctccccatcacccacgacagcatttccctagtgtgctgtgttcagtgttaatagatgttcctttaagaaatgtctcacgatcaagtaagaatgggagatgctggggtgtacacattttgccttccttctcctttcccctccgttgagctgataatagcagaagagtctttatatacagttgcttagtgtgggtgaaactagataaatccatcacaggccctcccttagaatatggaattgggactaagagaccccaacctcgaaagtctcttggacctgggatcccttgggcagactggttccatcctgtaagacagggaacctgtagagaaagagtggagttgagagagaaaaggagagtgctgacaatgtctctctttcacatgtttctgtgcctggctggctgcctctacccttggagtctgagccgcattcctggatccttatggtaaattctgcttctttgcttaagctagataaagtgaatttctgttacaaccaagagtcctactaaaagccacgtgtaagctatagttatttgtttggtactaacaacatgcaagcaccaaagcactttccatacattgtctcatttaatgttccagatatccccatgaacaaggccagcttcagcacaggcacgtgacctgtgcagttgaacaaggcctggggggtgcctaaaaagattctacgattggtttaatgctctgatgtcaccatctagaaagtcttagtggtttttgacaaaagggcccctcattttcattttgaactgagctccacaaattacctatgaggtattatctctatgtgacaaaaggtttattttctgccagacttattagtgcctttaaaatcaaaatatgcattgtaaatatccaagtgagggacataatatgcaatgtgtcccaaccaaatttgaccctagaagacgtttcttcgtggagaatctcttacaggtttggtgctctgcaagacgcagattaaagccccaccctttagtgatctgcctatgtccctatctcctctggagctcatgattccctatgcacagtgagcagtttcttgcttctgtgccttcacatatgctttgcaatctgccatgctcattaagcacttctgattataattggcttctctttagatttacctacaaggaaagaatatactcctcaagctaatgtaaatatctcgtgtgcttggtagttgaggtggacattgtaattgacaccccaacagccattctcgtcacctgggagcttgttagaaatgcagaatcttggccccatgccagatcagcttaatcagaatctgcattttaacaagattcccgggcaattcctatgcacaataaagtttgagaaacattagtaagccaatcacaataattccactccgcttgctagaaactggttctgtaatgggcgtgccttatccattttgagccagtgagacacaaagaggtgctaactcagagcttctggaggaagaaaagccagtccagtctctctcccctgagtgtaaacaagaaaacatgttgccacagttcccgctgacaggcatcttatgaccacaagggaaatcagactgccagtagcctatccagtgttctctctccccttctaccttaacaactggtcctggtgtgtatgcccgtatggactggaggaggcacagaatggagtgtcttgaatttccagcaacaagcattgcgtttgggaatgtgtctcgttggcctgttgagtccagtggttctcaaccagagttgcacatcagaatcacctggggaacatttaaaatatattaattcccaagccctaccaccagagatttggatttaatgggtcttagctgaagcgtggacatgggtactttttaaaagctccttacagccgggcatggtggctcacgcctgtaatcccagcactttgggaggctgaggtgggcgggtcacctaaggtcaggggttcgagaccagcc

SEQ ID NO: 972 - DNA, 1719 bp, Homo sapiens
aaaaccctgacccatccatcttcagcacattcacatgtgtaataaggtaagtgatttttaattccaccaggtttaaagacccctgacgtgacttattgccattctgctactgagccttgagagattatggtaagtgccaagaaaaaaaaaatgactttgaactgctctttcaccagttaaaaataacactgaaaccaaatgtaaacataaaagaagtggtcagattcgggttacatattaacggtgtttggtcaggctggagctgaggcacagcagcagagaatgccttttacttatcactgtttccaaacctccctacctggactaggcttgactggatttacaagagaccttttgaaaagatgcagagaaggcaagcagcacacatttcctggtaataaattttaaaggttgctaaaacattccagagattttcactcaacattcctctggccaacacatctgcaatctgccaatccttaaaaataggtgtttttgcattttaatctcacaaacatctttgaaaatgcatttcttctctgcccctgtgttggacaaatccagctttttccattttctaaaaaccacagaaatataatgctgcttaattcatacaagactgagctaactggagttaaaataaaatttctgagagtttgtttggctcactcttccctaccagatgattccattcttaaaacggtcctgtgattatattctctcattacagaggtgtccagaaaaaaaataaggagtgcagttctgaaattatataaaagcaaaattattactctaaacgtaagagctgtgatagatcgtgtcattgaccatggttcttttcccctgacacacacgtccccaccacccacccactgtatccatatgccttttgccatatgactttgcagctctccccactaaaggggcagccatgcgatttgctttggccaatgaaatgaggcagtagtggtggtatcctagttctgagcctaggtctcaagaagtcttatgtgtttctgcttatcctcttatacctctgccatcaccatgagccaaacatcccccaagtagcccactggtcccaggacaaggagggagacatgaagcagagctcatccagctgctgcagccccacttgacccagagacctacactgggaagcagagctgcccagtcaagtccaacctggatgtgtggaaccccagccaacctgatgcatgagcactcacggcattggaagacatcataaacattaatggagagcgggatgccagaataagttgatccaaatgatgcaggaatatttagcagcaaggagaaaggaattcacatttctcagtacccactatgtgccatactttgtgataagatggtttccctccaatatatcctcattgtcagcaatgtcgggaaacaggaatcatttccccttctacaggtgataaaactgaagcaagaaacatacaggctaacatcagctgagctgagatttgaactccactctttttgaccctggagctgatgaatgctgcttctagaggttgagtatcccttatccgaaatccttggaaccaggagatttttggatttgggaatatttgcatatacataatgagatatcttggagatgggacccaagtctaaatacaaaattattttgttgtatatacaccttgtacacatagactgaagataattttatacaatattttaaataat

SEQ ID NO: 973 - DNA, 11065 bp, Homo sapiens
cttttaaagatggatgaggcctcggttcaatgagggccccaggcaggggacggccacacccaggtttttggaggggccggggagggcgcgttcggggatggcactgggagtgggcagggctgacgcccctttgcccccagcccggtcttcctctacggcgacttcgccgcggggcagtgcggggaggcgctcagtgtagagctcgtgggggcctccgctgacagcggggcagggactgggagaagggcggcggcggagcaggtcgcgggctggtgcggggcctgggggcactgccgagcctacactgcggcggccgcggcggcggcggcagcgcgacaagttgccatggcccggctgccgcagctgccctcccaagggtctcgttagctctgcttggccggccaccgccgactcggccctagggaccccggcgacctagcaaacagccgatccgccgggcgctgacgaggctcgggggaagagggcggcagtccagatggcgcgcaagtgagtgccaggccgcgaggatttgccgccgggacccagggcgcactagctaggtgcgccgcccacccgcggcctcacgggggcgcccgagtccactgaatgagcccggcggggccgacagcagcagtcgagcgcgggtgcgccactctgaccgccgctcgctggtctcattgccggggcctgagcgggggctggggtgggtgccaacgaggaaagcacagttgatctgcaagttagtgggcggggagccagtagggagggactgcggagccgcgctggtcctgattcttcctcactcagctattttaatagcaatgaaatcttgaaggagtgctctgaggctgatagagctgtaggaaaaggtcttgggcgttcagatttttggatgcttcgtatttttcaactttattatctggcaacagtctttaaaactcaatgaccaattccagttctagccttaaacccaattaatccttaactatgaaagcagcatcctaaagtctactttcacttgttagcggcatctgtggaagtagccgagggtctcaggcagtgcagtagctctctgaatagcctctctttcctgagaaagggagcctcagctgctgtgcccaccaggcctggtgggagcgtgcgctcactgcgtaatagagcagggctgtgcttgtgaggtccctttggcccaaactgtgcaggatctgctgcctgcctttcctttttgttgtatcgttattgctttggcccagaaagctctgatgctacctgcctgcaaatagctcatctttactcaatacccgggtcctcacccctttatactgtgccccctctggactgtgatgcctgatgcttgtgtggtcagattgcattgacaagagatctcttccttgtcttataagggcactaatcccatcaggagggtcccaccctcttgacctagtctaaacctaattacctcccaaaggccccacctcctaatacctcattgggggttctggcttcagcataggaatttgggggggcacagaagactttaatccacaagagatgggttcctgacagtagtaaccactccccatccacccctgagtgctggtagtcagggtcacgttagactggagtggtatagagaagacttcaccactctgtagaaaaaggcaagaagtcttaactgaaagggaagtttctggtccctttttcaaaattacctccctggctctttaaaatgctgtattttataaaatgttttcgatttccctttcagatgtgcaggccaacctcaaggtgtgggttgcttagattacaaaggaacttgaattctttcatgtttttgtttaaagtatcactatcatcatctaaagccaagattggctgctttgaggaccttttctgaaccgtgtactaggataataactctgaaggagactgttcttggaaaaggctgatgttgggaccttgctagccattttggaattagggaatgaggtgtattggcatgagcagcagcacttttgtggctgtcaggcagagattttcttttcttttttcctttataagtcacccaacccaaattgttatcaggcagatatttttataggggtagtgggaggcagttcccaagtcccctgtccctctctgcacctagtctaccctctaagattgcaaccatcatagcatcttcttacacattacaatgcagtaaacttgggcacattgagcaccagtcatggccgctgtgttcctgaaggtacagaagtggcactggggccaggctgctgtctggaaaatgttagccactttggtggtactgcccttccgacaccgcctcctcacctcccccacccctacacacaaaaaacaagacaagtagagcaaacaaaccacttctccaggtagacagacctgcaggtctgctcatggtgaccctctctttagcctgcattgtttccaaggccttcagctggcctattgtttgctaagggcccacaccttggcaggagctgaaaagagaggatttccttttgctcaggggaggagggtctgtcctgggtttgcagagataggcttcttgtctatgctgctgaagaaaacaaactagacaggagtcagatgtgggctctaccttcttgctcagtctctaattcactgtggccttgggcagatcagttctccatccttattagtatcttgggtggaatactccttaaggaatctttcaagtattgagtgcccccatgcccccaccaccttccacaaccaggcctaggtgaggcaggaaggaagaaaagaaagtctgggtgcagagtgtgtagtatgcctcacagtacagcctgcaggaaggccttggataagaaaggctgagtgatattccagggggtgggacagaacagagtgtggtttgggtgggaagatgacctggtgaacctcaggttctctcaaggctttacagaggtgggagcagggccatgggtaggctggctacagtatccctgctgaaagggaatacttgttggtacaaactcagctcttggggcaaggatcatatgaacttgcggtcatgaaagtgtaagtagggtagaaatatgaggaagggagaggcacttggtcatggccaaggctggagtgtcattaatgtgtgggggttgaggaagcaggtcacaggattgttggatggctcattctacagtcttgtgccctgggagcccctcatgtgggagacaggtggtggatgtcaggaagagctagaggtgggaagggtaggcttgatatttagactatgtgtcaagtagggcagggccagttactgaaataccgaaacactagttgtcatttggaaatggctgaggccccaggctccctgaggcccccagccaccttgtccttggaaccttgctggtgctcactggcccatacactgtctgcccagtgtattccctgggctctgaccccagtccctatgtgtcctcttgaccagggtatgcacctggacgtcagtgggaattcacttccccaggggaagtgctggaatccccatatacacttctggctcctgaggctgtgtctgctggatggtgcctccccagtgtcactgtcccgtggtggcttgtgggaaccctgcctgcactgtgaacggtatcggtcgttatgtatgctgacaatcacccctggtaaaggaaggggacagtagggtgaagaattctgttttgggtgcctggccgctttgcagcggggacagagggcaagacctggcaggcctgcagtcttcctcggctatcgtgaagagggttgtgagtgccaaatccatcccatagggagatcccagaggagactctggcaccccctctgccagagggcaggcccatgagtgcggccctgcagaccaacagtttcttaccctccttccttcgcgagacctggcacagctgcctgcctcactcctgggagccgagtcctactgggagctcgttcctgccaaggctgggatccagtccccctctcccctctgtgggcacttggcaggccgaggtccctgcttccctctgccagttcctgccaaagctaatctccctgcggcctgttcctggcagtggttgcacgtgggtatctctgctgggcaggcctgcttccatcactggcacggaccccatttcccaagaatcctttttgggtggcacaatcccaggcagaattctcccaggaggttcctgagtgcctcccttgctggttcagcacctgatcacgttcctggattccccctgaactcctccagtgtctgcaggatgcttttcagttcacaaagcactttcatattatatctcattagatgctcagcagcccctcaaacagcaagtggtgcccttgagcctgcagggccctggagtgggcagatttcctgaaccatctgctctgactctgcctttgggccagtggagaggcctttgtgagaccaaatcttcaggttctcggtggggcaggtggcagttcagtaggaggtggcctcgggcctcctcttctggggaaggtgtcagagaggggtcaggagactatgtagcctcttgtggccccagtcccctgatcaaaaaccaataggaaaagtctcttagaagagaaacagcttttgggttaatctgtaggggcagtgagaaagggttggggaggttggggcccagctgggccacgtggattcgatcttggcttagagtgggcacaggaagctatgtgatgaaggggagcccctagggaggaatctgggtacaggggatggggctggaatcagctacctggtccgtaagttgtgttgttaaatttggagaaaaactgttttccaaaaatggaggtaaattgaagtttgtaagagctggtgaataagccatgcctccttggtggtttggagcaagacgttttccacgcaggccatttcatcaagactcagtggtaatttgggattgcctcagctctcccagctcggctgcctgttgctgtcagtgggtctggggggcctcagggctgcagaggcttggtggtgtgggagtccttcacctgagggctgacgtgccttttgggggtctggagcatacttccaggagacaacctctcttcctcctgtcacctctgctcctccctcagcctccctgtgttcctttaagcagggggcatgggaagaatttcttctgaagcaactgatgttctaaatttgagagaggggaataccatcatgtggcctgaagttagcagcccagaggctgagggctgtggctctggcaggtgctggtgtccagggtgcaaggaagactccaatgtccagaggactctcatgaaggtgactgggagcagactgtggtggaggtgacagctcagggaggaagatgggattgtcaggactcagttctttgctggaagagacttctcttccatggggtggtgagtccaagtgagaccttggttcctcttcctgggtagaatcctcccttccattggaattatcctaaaggtccaccccactgactcctagcggcctctttcctggtaaggaagtctgattggcttttggcttggctaacctgagtcacttcttccagagctgtcctcatgctgcagccactgctgtcccacagcagctgtgggtcatccttcagctacagatcctcccattttccttgtccccccatcagtgtgcgtgcacacttctgtgtatgcaggtttggggtaggcttggtctgcaactgcgggggccatgcgcagttgagttcagtctggtcatgccacagaattatttacactgaaaccctaaaaccctctagcgaaaggttagatctttaagtcagacttgtttggcaggtcagtgagatgacagggaggtttaagacctgaattgggggatggggcacaaaggagtcgtggctgtttctggatctaaggcctctgtagggaggtgagatccagactgggtagaggctggtgattcttctggagccaactctgtgccaggccctattgtggctgtggaggagcatagttaaaactctgtgctttccaggacttgaagtctgtgcactgcccttactacgataaacaaaggaatgaaagttcctctcccaggtccatgattcagagggctcttaggggtatgtgtgtaggaggcggtttgctgctcatgcagacatttggagaaactctggttccatctcgtcacccccacaccagcatccaggaagacatatgggcagactggtgcgggccagcaggtgtggggatgcttctttgctgtgagcttctgccaggtgttagagagggaaatcgaagtgtccagctgccccagagctgggagtccttcagatttaccagaactttctgattacaaagacttcctgcttattgttttgattcttaggattataatcttacttttgctttccatgctcacatccccagtctgaatctggggctgcttctcaccactgccagcctcaaggcagagaaggcaggctcctctcccatttgtgttccctctaaatggttgcataggtactcgcttgcagaaccattactaccaatagtggaaaaatgagatggggagggcaatatacttttattcttattttatttgagacaggttctcattatgtcacccacacccatgctggagtgcattggtgtgatcacagctcctgggctcaggtgttcctcttgcctcaggcaatttttaaaaaatttcacacttgattggccaagaacctcccctccgacccccacaacaacctacccagcatttactcctcagtctgaggacacgtccctcacatcagcccctctgctgtcttgaaaggctcacctcctggaagctggctcctccctgattcagggcccagcacagcgtcggaaaaatggagcagtgctgcccactgtgttcgaaggcctccctcctctgttttattctgggccccttgggcagggcttacatcagagccagtcctccttggctgattcaaagggacaaactcctgggtcagtcctgaggacaaggaatagtgagtgggtgagggaggggctggcaacaactggagtgtgtctggccacaagctagactgtggctgcagctgatggccatcatcaagctggcgccaaagctgccctcctgcccaggtttccagagattctctagctagttctcttctctgttctttggaagatttactgccttattccaccgctttagtggttatcctacaatttcctacatttttctttgacttaaataagtaaaatctttactccttttcctgagccattcaaggaacttgggttattttaactttactttcctcctgccttacatgattttcttttaaaaacttaattttatttataattccagagttatagaaaatttgtaacagttggtgtacagtatttccatatatcccctctcaagttccatatatattaatatttaactacatataccttataattctttccctccccaacatcatttttttctgaactatttgatactgatctacatatatgtgctgtgttacccctaaatatatccttgtgtatttcccaagatataaaaatattctcataaaattatcacacagttatcaaaagcaggtaattaagaagacacaatgctatactctaatttacaaaccttattcaaatttcaccgaatgtcttagttatgtctttatagccagagaaggaaaaaaatacatatttttcttgtctaggatttagtctagaatcatgttacatttagtcatttctagtcttctttaagccgatttctcttggtctttctttcacttttcttttttgaggggtacaggacaattattttgtagaatgaccttatttgggtttgtctgatgtttcctcatgattagattccagttatgtatttctggcagaaatgccacagaagtgatattgtgtccttctcagtgcattgttatcaggaggcacatgatgttggtttttgtcccactgctggagataataactttggtcacttggataaggtggtgtctgccaggctttgtctgccattgcaaagttaatattttcatttggtaattaagctttgggaaatactttgagatgatataaatattctgtttctcatcagactttacccactaaattttagcatcctttgatgattagtgtttgaggtataatggttgtaaaatggtgaattttctgcttccattatttctcatacatttattagttgttactctactgtaaggaagagtttacctccctccctcccaatccatccatccatccatccatccatccatccatccatccatccacccgcccatccatccatctacctacccacccatcttccattcagtcagtctggattcatagatatttattttatttaattagttatgctttgttactagcattggtgattttgatgatcaaaattatcccagattagtcctgtgagagctcctccaagttgattcttgtgtctttttgacacactgctattactttttgagcacttccttactttctgttactacaagatattccaggctcatcttgtactttcccggctcaaactctgtaatctggtatttttctaagaaaccctgattccttttagcagagaattgtgtataaaaacaaaccaagacctggaataggtctgttcattgccagagtgttgttatttttaggccctgtcatacatatacacacatgtgtgtgtagtatatatattatgtaaatatgcacacacacacatgcaaatccattcatctatctacctacctacttacctacctatctttcttaaaaaccatgagttcatactgatatgaccagttccaatccaacactctagagttcattttaaccttctctctttccatatatgtaatttccttctccaaccgtgaaaaacctggtttcagttacccacagtatatttacttatttgcttaatcctagaatacacagaatgtagtttcagaattgttaactcatgctggtgtgggaaacaaatctattaaacagagttcaatatttgctactgtctttttgccctagcctgagaatacagaggcaaagtactgcttcaaaacttctgttatcaccccctacccgtactgtgttttgtcattcacttaacctacagttcggtacacttgcttccatatgtattcaatgctaatgtttcctccttttatccttgttgattgtatttactgaaaaactgagtacatgaaacattaacatggttgtaaaagtcagaacagatctgtacaaaaacatgaactcagagaagtgtcactgccctccatcttctctaccttgctcccaccatcttattcttttcacccatcaggctaaaaaaagacatcagagaaaaatatatcctaatatgttgagtttattcgggagtaagcaaaaggattataatctgggaagcacagctgtagcaagccataggtacaggtacatcaagccaaaggtaaagggaaatttttactggcaaggagaagctatgtaagctgcttggagacagagttcattggttctggaggctcaaagctagaattagcatcagttcattggtggagatgccactgctaggcatcggcctagcatcttatcagaattgctacagtcctaaagaatgtatagtgataaacctggtcatagaaatatgtgcatgcatgtaaaatgtaaaatgcatgtaaaatgtagatcatgaaaagcatgagatgtataaaagatgaaggaatttctcgtggagttattttagaaagtccttgaaatagtccttatctcagatgtgcaagcatgagctgtgctcctttgtgtgttctggctccagtttgctcgggtctgacaaaagtgacttattttgctatctgcaactttagtcactccatttccacccactcctgtatggaaccaatctcattagtttctgggtttcctttcctaagtttctttttgtatagttgtgcagacaaatatatattttcttattcccctttctttcttgcacaaaacgtggcataccataaacactttctcacactttgctttttaaatttaacagcatatcttgggagccattctatatcagtttatagatgtcatcctcattcatttttatagctgcagactattccattcgatgatgtaccatagttcattcaaccattttcctatgtaaagtcattttggttgtttctaatatttttcaattataaacaatgctacaatgaaaatccttaaacatatgtatttttgtatatatttgaatatgtattaccaggataaattataaaaagggggaaaagcatgtgccattttgtttgatatcatcaaattctcccccattaaggttgtactaatttccattcccatcagaaatgcttgagcatctactttcttcaagccttgccaacagaacgtgttagtgtatgtttacatttttgccaatctgctaggtgagagataatatctcagtgttattttaatttgcatttctcttattatagttgaggctgaatgttttttcacatgtttacgggacattttaattcttttttcagtcaatggtctgtttatgtctttgactatttgaccatttttatatcaggtttttgaaacttctatcgagtagaaaaagttatttatatattagcgatattacatatgtatctgtgttatatattaccgatcttttctctcagtgtttaatttattttgggatttttttttttttttctgcgacagagtcttgctctgttgcccaggctagagggtagtggtacaggctcggctcactgcaacctccccctcccaggttcaagcgattctcctgcctcagtcttctgagtagctgggattacaggtgcccgccaccacgcccggctaatttttgaatttttagtagagacggggtttcaccacgttggccaggctggtcttaaactcctgacttcaggtgatctgcctaccttggcctcccaatgtgctgggattacaggcgtgagccacagcacccggccag

SEQ ID NO: 974 - DNA, 1644 bp, Homo sapiens
acactgctggttaactgcttcggaagaggacagcccgcagtctggagtgagcagcgaagcagagaaaaggagacgccctttcggacaagggactggttggtttgttcttgtgcagagaacccactcgctcactctcaaacggtagctgttcggtttatttgtccttttgcagtgtatgcggagccccactgtgtggcacgcacttgcttccggcagagatcctgcccttcaggagcaactaaacttgttgcaaataaagtgctgtgaaagttcagaagaggaagatattagatataacggcatcattctctcgttttttaagtgttcctattatgtgccagaatgctggtccagtgagggctttatgaaggccatccagactacaggaacagaattgctaagcacatggggcgggaggcggagggaatcctccagggagaccaaagtaagtacttcagtttccttgaaggcttgtgtgatgggaaggagtgctatggtaggcgtcactacatattctgttcgttttaaattaaaaaaccatgggcacatattgccaaaaataaaaaagggaaggaaaaaggtatagttgggagatagatgaatacaagagaaattaaggacattaatggtttaagccttgaaaggctagaggtggaactataactggacaaggtggactagggttgtaaagtcctctaacccagcggacggggtgggggtgtgtgtgggttggggatgaaactgttccacttcagatcatcaggcattagattctcacagggagccggcaaacctcacatgtgcagttcacaatagggttcgcgtgcctatgagaatctgatgccactcgctaatctgacagcaggcagagctcaaggcgataatgctcactcgcccgccgctcacctcctgctatccggcttggttcctaacaggccactgtctggttccggtccgcggcccagggcttggggacccctgccctcttgggtagggaagtatgggaaagcagtgctttagggccaatgaatctataaaacggctgaaagtggagacagactgttggcaaggaagtcaagtggttaggaaactgcaggcccagggttacttagtagtggaagtaagaagaggtaaatagaatcaatccgtcttcattaaagcaagacttcccagaccactctacccacacccttcaataaatacacttacctgtatcattcatttgatttttattatctaggaatgtctgggaccttatctgttccaaataaatgatatttgcagagcttagctattttaacttccaaaaagcaaaaagaatggaaaataacttgctccataccctgttttctgtagacattctctgaagtttttcataatattgcttaaagaatgaaatgtatacaattcacaactgccattcccctctgaaaagttgttacccaccaaaaaatagtggtccaactcatgcatcaaaagcaagtttggggatcccactataatagtctgttctgactcacaccatctgcccaaattatatagatcaggctgccctgacataaccccagccacacaccagcagcggcccccacgctataacaaatctttaaccaattattaaaatattagaaaatgcatgaccat

SEQ ID NO: 975 - DNA, 1498 bp, Homo sapiens
ggccccgtggctagagatggactccagattcacacccaggctgtatgtctgcacaacttggactgcacaacccagcacagagaacactcgacccccgctcacgcaacacagcaggatcccgagcttggaacccaggtgttcacaaaggggtcccgactctggaacccaggcctccacagcaggatcccgaccctggaacccaggcgtccacagcaggatcccgagtttggaacccaggcgttcacagcaggatcccgaccctggaacccaggcgtccacagcaggatcccgagtttggaacccaggtgtccacagcaggatcccgagcttggaacccaggcattctagtatccagcctccaagtcttggtcctaccctggtggtttacagaagccgagaagctgacagctttactcacccatgacaaaataagaaaagcacagggcaatgtaggaagtttttcataaagttaaatccctttaatttaaaaaaaaaacagcttttttggttgacttttcccctctcttttctaaaataagggtgatcttatccagtggttcttattttatattcttaatttagcaagataaaaatgtgagcagctgcacgccagcccccaaactctaggggaggtttttctggttcagactgtctcaggttcgagcctccttagggcaccccctttccgtccaccttagcctggaactgagacttctttttcttttgtatctgtccttctcagatctcatatttgtattttccaaaacaatctagttgaagaaatcctatttggtatgtttgaaatctttatgctcccagctcaaactctggattaacaacaaaacagaggaaaactctttttcttattcagcagtcaaacttcaaggcaacttcagccctgggaactcagccagttgctgggaagtaaaggaatcaaaggcttctaaacagtaaaaaatgtctttagagctcggctcagagggagctttggccttcctgcaaattaagaataatgatttggtgagcttgtttatctcccctccaccagcaaggcttggtctccccaggggtaaccggctgcagattcaagaggaagctgggagggctgtctggggctggagaaggaggcagctccaacacgccgcggtcaggcagtgtggggacaaagaggtctccttacttccacagcaccgagtcatcgaagtttacaagacacttctacgttgatctggaaaaaggaggtgttcctagtacatcttagaaagatttccataaaacgggctaaaaagcaatcataaaaccacaacaaaacacaaacaggcaagggaaaggataaacttccatcacctggaagcctcagagacaggagagggtacacaggtgagagccttggctgggtgggaggtaggagtcagaccggaccctctgcagaattagcagtggtgtgcgctcacctctggagctgctcctctgagatgggcctggccccctagataat

SEQ ID NO: 976 - DNA, 4310 bp, Homo sapiens
tcattttttaggtgacattagaaatccggatcatgttaaatctagtttttaaatattggcaacaaatccacttgttaaaaactgcaatgatcaaacatgtccataggtcaaatctggccataggccaacagtccatgctctccagctggacatgtcaaggaccaaatcttctcaggcaactgctgatcgaacctccatcaagcctcagggactggggcaaaatagggtgtctacctagtggcccacaggccacacaggctattccagaatctggccctcaacaacgacttgagaaggtcacctcaattcctttcactgaaccttttttgttttgagacagggttttgccctgtcacccaggctggagtgcagcagcaggatctcggctcacttcaacctccacctcccaggttcaagcaattcccctgcctcagcctcctgggtagctgggattacaggcatacaccaccacacccagctaatttttgtatttttagtagagacggggtttcaccatgttggccaggttggtcttgaactactgacctcaagtgatctgcccgcctcagcctcccaaagtgctgggatgaaaagcatgagccaccaagcccagccctttcactgaactcttaaatggccctttccaggccaaatagcgttgcctggaaccatttagtaccatgtaccatggttctcagatccagaaacaggatccgatcacctatgcattttctaatacataagccctaagttattttaggtctataaaaactatacgctaaggtgggggtaaaaaatctcacatcaaatataaaaaatttaagtcattaaaggagatgaggcatttgtaaagaacttttaaaaatatcttaagagctggaggggtctttttgttggttggtttgggttgggttttattggtttgtgtttagagtctggagtatttgctttttaaaaaggcagtgaaagaaaaaaaacgaaccccttccaaacacatttgtcatttttatatactatatcatgcatgtttatgctggctacattaggaacaagcttgaattacaacccccggtttacctaatggagttctgaaaagccgtccaatcttcctggaagagggagttgggaggaatgtggtccagtttgcacttctttcgtatggactggagagtgctggtgaaatcagacacatacctgccgggaaagggaagaaaatggtagggaggtcaccactgattccccaactctaaagagacctggaattctacagctctggacaaattgctaatggccttgagagcatctttagaggctcccaccgacgagtgaaactgcttgtaaacctctgaacacaaaaagttcttctctatgtggcaagactgtcttcaccacctggttgagcagtttctaaaagagatgcccaagaggagaaggaaggaataatcgtgaagttgactccagggagcaaccaggtgagagatgatgctgataaatcccccctcatccagataagtacatttctgtgaaagcaggtttgaagaactgtttaaacatcacggtcccatggtaataactgactgtgacctgggataacgtaaggaaggtcatgacatccaaggtacctctgcatcattctcatcctctaaatttagattaaatacccgtggcaaaaagattaaagtttcacggctggcaagtgtctgactttaatgggacagacgcatgaaagtggattcaaagccaggagatcctccctcacaggctgcgttgtttgctctcactgtacacacatacttttccctcacagcatctaaaacactgtaattaaacagcttgtttagacagggcatggtggctcacacctgtaatcccagcaccttgggaggctgaggaaggaggatcacttgagctcaaggagttcgagacctgcctgggcaacagagtgagatcccatctctaaaaaaaacaaaaaaattaggcgggtgtggtagctcatgcctgtaatcacagcactttgggaggccgaggtaagaggaccacttgtgcatggaagttcaagaccacactgggtgacatggcaaaactttgtctctacaaagaatacaaaaattagcctggcgtggtggcgcatgcctgtagtcccagctactcaggaggctggggtggaaagatggcttgagcctaggaggtcaaggctgcagtgggccatgagcacgccactgcactccagcctgggtggcagagcaagaccctgtctccagataaagaaatagcttgtatgatgcttattgctgctgctagactttaagctctgggagaacagagtctgtgcctcatacttatatccccaggaactagcacagagctggacataaaggagggagtcatgtcctctgaaagctacgaaacctgtgcctcatacttatatccccaggaactagcacagagctggacataaaggagggagtcatgtcctctgaaagctacgaaacctgtgacatttgcatgcatcacaagaggccttgccgcttgcccctcccaaaacgaagctctaaatgaggaaagtgaaatgtgaggacccagggcacagccccaaaaggtcagtccatgcagtggagacacaggccactcaatgaaccaactggaagaaacggcttcaggtcactccactgactgcaaatgatcctgctgctccctttacagagagctcgatgctttcaggtggaaagctgcaaaacccagagtaccactgacaacaccttccccttgcaccaagagaggtgacagctttctagggttataagtcccaggaaggagaggggctggcctcaagcacaaactgacaggggaatgttaaggaacatgattgtgctttagccatgggaagttaaacaaccatgtcaccacctctgcaactatggcaaatatccatgtgctctgcagaaagagcaggtacacactgcaggagaaggagttttgtttagccactattctcaggtatggttataagcaaatgctttctctatttcattagctgtcaatccagaattctaaatggtttgtcatgaaatctcagaggaaaagtgtagctttcatcacatcatttttgttcccaaaccctccagctgtttctcacaatacacatttccaattgtcaaccatgtcagagtcaccgtgttaggggctttaatgatatgcttttggttaatattcacaacctccttggaaaggagatattgtcatcatcagtttactcagagaggaacactaccatctctaaggtccccactagtaagtgtccagagctcccatgcccatcacagtcttaatacccctccttcttgaaccaccggttggccactatactctatgcttcatcctagttcgagttaggccaacctgcacctgcctttcctgcgtaccctgttctccttgcccctgcctcccttaatacccttccccaaaccctcctcactactgaacaatgtgccatttgaaccctgctcaagttagcttcaacctgatttccctgattttataagcatcagctattttggtaacttcaaaatcttcccttttagagaagatggcctgggttttccagatatacttttgtacagtttgaatgcttaatatggaaatgtattattttgatttttttttattttttattttttgagacagagttttgttcttgttgcacaggctggagtgccatggcacagtcttggctcactgcaagctctgcctcttggattcagcaatttttatgtctcagcctcctgagcagctgggattacaggcatccaccatcatgcctacctgatttttgcatttttagtagagatgagcttcgccacgttgaccagggtggtttcgaactcctgacctcaagtgatccacctgcctcagccacccaaagtgctgggattacaagcgtgagccaccacacccagcctgatgtttctttttctgcaggaacacattcaggctcatccggccacaccagatgatgtgttcctatagaaatgcctacgtggaactgccctgggaggtgctggatgcccgatggcaatgccagggagctctgggtccaaggagcctccacagttcacagaggcatgctcagtatttctggaacaatcagagacagggcttcaccatgttggccaagctggtctcgaactcctgagtttaagcaatccacctgtcttggcctcccaaagtactgggattacaggcgtgattcaccgcaccaggccaaaggtcctttttcttgttcaaataaactttgttaaatttaacttgtc

SEQ ID NO: 977 - DNA, 16464 bp, Homo sapiens
gtaggttctttaagcattgacgagctaaagaccattttaaattctaagcctagggaagcttacaatggaactaatcagatgtttttatgtcggtttgttccgagacagtggaagactggaggtcatgtgcttgtgtctaatgtttagcaaaatcttagtgaaacgagggcgataggaatgggggctggggaagacttagatgggataaaaagaggtgcggctggaagaactaaatcactttaaaacttctgaaaataaatgttgaccattgtagtcagaggagtaaaatgttcagagaaatggggatgattaaacaagaacggcaagccagattgagtcagaaaattatcttcctgccagaaattctgtctcccacaacggcatcagggggtggttacttgcccagggtgtagtcagtttttaaaaagcttaagggttaccaacatattcctaaatttcctgaatttgctgtgattccaggattcatttaaactcttgagactgttttactttcggcacgaaatcagctcatgggctttataaatgtagaacctactgcattatagttcttctttttgtttattctaaaactgttagtagcagccagcgtattatatgatttggattgggccatgaacaaccgtaacgagtgataaagcaccctttcctgttccaatgcaaagaacaactatgaaaagaaagtactggcaaatttatcatcttgtagttagttcctggccaaagaaaatggtaaggccattcttttaagcagttaaaaaaaaatggggatgggctcttaaactttggcatgctaaggccattcttttaagcagtttaaaaaaatggggatgggctcctaaactttgacatactaaagcagtcgtcatttaggtaaaatctaagtcttaatggaaatcgtgatttcatatctactgcagcgttagcaatcacataatgataacttaaatcagtaaatcgttgaactcggttctctaatctttgaagaatagaaatactttttatcccaaaagatgttttgagaattaaatttgcagagaattttttaggtctttagttgtaatttatagagctaggtcttttaactttagtggaaaccatgccctccaaacccaagtgactggagtcagaatgtgaaataagacgacataaaatccctatttcttaaggggctgggcgaaagtaatggaacaaaatgtaacgttatgctattgtggcagagatagctaatggaatgtttcatttctaagtctgtaatttcagtaattgttagaggcagttttccatcaataagttagatcaaatggttaaacccaatatgaatttataaaagcttaatttaattttggattgatttaccagatgtttaaggtggttataatgggtagtgttgatggtggtgcttttggaaaaatgagtattatatgcctgctcatccctttacattatcttatcatataaacttcttgattactcgttatgatactcttaaatcgtacatttagaggaaaaatcttaaagtaatctgtaagaccatttctccttaaaatgatatattatgagatgaaaggaaagataaagataatttagaagagatccagaagtggactaaatttctggtaaggagggggctaaagatgttaaaagacatcttaggaaaagcatatgatttataacttttaaaagtgtcatttagatggttaaggatttgtgtttaatagttctcttgaaaatattgttttccaaaagtttaaaagccctagctacttttatacatttgcccttaaaaaatgtacagaatttattacatcaaactgctacaaagaaataagaattctgatttttgcaagtaagttggaaatcaacgtagaggacaaaaagtggcatagctatatctaaacaaaaaagtatgtaattcaaaagttggtccacaaagaattgaaagcctttcaataactaatttaaatgatagaaagcagtatgtatatgcaagtacatatgctccctgtatagagagtggttagtaagtaagatggtagcctaactcactggaataaagagatccttggagtcccaaacctcaagactaggagtcttaatgcagttaccaggctgcatgcctgtacccagagaccatactagaggctgtgggaatcctcgattactgctcttagagcccccaacttgactgtttcttctgtacctggtacttttttcaaatatttcaaattgcagtgatgcatgggagatacatttagaaaacataatgcaggggaataaaagcagttaaaaactaaggacagtttctactgatgaaaataaaaaactgctacagcaacatcttttcatcatctgtaaacatcatacccccaaattttcctaagttattatctaacctcatcagtagcagatggtgaattatttcatagaaaatcctggaatgtaaactctagatactcaagaaaacctcttttttttcaatgaaggtatattatatttaaaataataatgatgcattaaacattatgggataaagaaaatactttccatagaaattaagcaatggcctaggcaaagagaagtaaccctttagcattaatactatcagttagacagtgacatttattgaacattccctgtgttgtgtattaagaattggactacctatatcccagtcaacaattttttctggagtttagaaatagtttatgcttattttctgtgttttttattaccaaattgttattagtttggtgcaaaagtaattgtggtttttgtcacttacatgatggcaaaaactgcaattacttttgcaccaacctaatagaaaaatacaaaatggagaatagttttcaggttccacaaagcatttgctggaaataaatatcagttgtctaaataagtagtacttgatttattactatgattttcgtagggttccatttctggaacaatatcatattaataaaccctttcagtgagaccattgtgtggtattgcccaaaaaggaaaaaaaaatgtaatgagaaaggactaaggctaataaaattccataaatactattataaagaaaagtataatttgactgagatgcacaaatgcttacttgataatgaggtgtttttaaggaaacttctattaaatactctttttgagtttaatatactatgaaacaatgttgtcttttttttttttttaatgaagatttccttgacttccaaagacctttgatgttcaagcaaaatgtagcaatttggtaaaagtaaagggtgcatttcgaactgaaataaacataatgtcctattaagacctgtattatattttatggaatttaacttagaatgtaagatattagctctgcggttttacaagcttgtttaaattctgcaatgtagggcaacagaaaatccaaacaaaatccattaatgactatattacttctttatttttctttttaaatattatatgtggccagtcaggatgaagttttttttaaactacatttcctagttggacagatcaagagtaagctccagttttgctataatctcgttttgtgattgctgacaagtctattactccctcagttcccctatcactaaaaagaaataacattgtggtaaagaggtgttaaactaccaaatccactgaaaaagtatggaaaaaggtcacagatgtggcagctttggcatcttcagaagaaaagatagcaactcaatgtgatactattggcaataccatttgttaattgaaaaaagaagaagaaagcagttactagacatccatgattttatggagaagccatattctgtcatagatgagctatttacagacattcaatggcacattctttgacaaagtgaatcatcactgtctagtctttcttgtatatgaatttgaagtattgattaaagttgtagcatacctgtaattttaaactgtaaaactctaacactcacaaaagaacattgaaagactgcaaatttctagacttggaggttataattccttctgtatgttactactatcagcttataaaattttaaaaaatgtgagtgtagaaacttatataaactgtattcacacatgaaggatagcctaaatgctccggactgataatctgaaggtcattctcacctggctgattgaactacttttattcatagaagccaaagttttgaaaggtacagatagaatcttgactaccttgcattcgcagttacgttttaattgcaaaataacaagctctttagtcactggaaacaaaacacttttagcatttaactttataatacttgaaatcctaccttgaaagcattcatactcattaaaagctcaacacatgatccatgtttacataaggatttgggtgttgcttaaaatgatcatgtaatgagctgcttctctgcaaattaatattcactcccttccctcatccttaatgtgggatctttgaaggaaaaggaagtgaccaaactaaagacatagggaaatgcaaaatcaaggtgaaaagttacccagagggttgttttaattttggccatcaaccccctagtgaataatggtaacagtattgttttgagacccattttgtggcatttacctattgttaaactaaattgactagatgtaaatatattttcatcttcagatatttagaatttctatccttccccattgtttctggattttgatactaatcttttttctttgcatattgtatatatttactcaacaactaatctaattttagatttttagcttatccacatttcatttttgtttatttcattggtatttcatcaatacaatggctctacccttcaaggaaaaaaaacatcagcccgtcccacaaaaacacatatattcaagaaagataaattacattgtgatgattcaatcataaagctactcaaggatgtgctccaccaaaatgaggatatgaagccaatataaaggaaggcaatgaatacaagagacaggcaaagggagttcccaggacataagcaagggacgtcccaggtagcaagtgtgcacctggtgtccagggccatctgtccaggctggagagcaatagggtgatctcggctcactgcaacctccacctcctgagttcaaacaattctcctgcttcaggatcctgagtagctgggattacagggagaagtcagctgccatgtcatgaagacgctcgagtagccctatgagattcccatgtgaacagaaattgagtcctcctgccaacaatcagccataatttgcaagacacgtacatgagctaccttagaagagaatccctgggccccagataagccttcaggtgaatgcagccctggaagacatcttaactgcaacctcatgagagaccctgagccagaaccaaccagctaaggcactgcccgattcctgacctacacgcatgggggtgcatggtggctcactcctgtaatgccagcactttgggaagccgacgtgggttgatcacttgagcccaggagttcaagactagcctggccaacatggcgaaagcccgtctctactaaaaatacaaaaattaactgggcatggtggtacacacctgtaatcccagctacccaggaagatgaggtacaaaaatcgctggaacctgggaggaggatgttgcagtgagctgagattgagccactgccctccagcctgggcaacagagactctgtttcagaaacaaaaacaaaaacaaaagcaacaacaaaaaaaattcctattgaaatttaacttacatgtgataaaattaatgtaacattttatatatattatatataaaatatatacttatatattatatatacttatatataatgcattatatatgcttatatataatgtattatatatgcttatatattatataatacatcttctaatatatgtgtgtaatatataatgtaacctgtatatcagtttcacagatgttaacttaacaagcaaagttcattgaaccatgcatttgtattctatgcactttgttatatatcacagtttaaaaggtccaaagtagagtatagacaggcacagtggttcatgcctgtaatcccagcacttagggaggcagaggcaggaggatagcttgagctcaggagttcaagacctgacggggcaacagagcaagatcctgttctccacagacaggaaaagagaaagtagagtataaatacagcataggatcttgaaaatcagactggatcaaaaggtgaccatgaactagcaattaaggttctgtttaaaaacaactaacacgtgttgggacataagaattagggtagcacacaataaactatctcctggcttatattttttaaatatcactgggtgggtcagtagtctgaacctggttgccaaggcagttcctaaacctggggagtatgactgataagtttttcaccttgacagcagaaagcagttgggcccaagagagggtaggcttgatgctagcaaaattatgaagatgaagccttaagtaccttatcttgtttgtgcttgccccttgctctgcttctctacacctttggattctcagcagcctgctgcttttctacacctttggattctcagcagcctgtgtatttgtgtacttatcccccttcccttcctgtcatctacccatttccaaagccaaggcaggtctaaagtcctgctttgttgacttctggttcaatcaggggtgtttctatcatatcacactggctgaaggtatttgtaccttaaccttgatctctgattatgaatgaaaggttttgggtcctattaaagaaattttcatcaccactgactagttatttgaggtgtattttgggtgaggtgggccttgctgcccctggggtagcaccttgtaagctctggtatggtatgccctggggagaaggtgtcagctaacttttaaaaatcactgcaggtgattcagatatgacaacctgtatcctgtatgacaacctgccttctgtccacaccccgtctctcaatgagaaccaccttttacaggaaggccactcataagcagatatatctatttattcattcattaaacaactatttcttgagctctaactgtgtctggctatgggctagcactggtgactcagggttgaacagaaacaggcataggccatgcatggtttagtgcaagacacacattaatcaaggcaagcaggtaaatgtaaagttaccagtcaggtaagtgtcgtaaatctgggtttactcaacataaagacaggtgaattgagagttagcttaataattatgattttcaagtataagatgaataaattatgtagaggagaatattatacactgtaaaaaagacataaaaaaggaagtttgctgtagcataaagaatttaaggtaatggctaccatagtcagagggcctgctctgtgccaagcatggtgttattttattttatttttttatttttgagactgagtcttgctttgttgcccaagctggagtgcaatggtacgatctcagctcaccataacttctgcctcctgggctcaagcaattctcctgcctcagcctcccgagtagctggtactacaggcatgcaccaccacgcccggctaatttttgtatctttagtagagacagagtttcatgtgagccaggctggtctcgaactcctcacctcaagtgatccacctgcctgggcctcccaaagtgctgggattataggcatgagtcactgtacccagcctgctgttattttatatattaaaaattttacataaatatattttacatatttttatatttttataaaatagtgattatatattatcatttattaaactcatatatattgataaagcctcacagaaccctacagagatttaaaaaagcaatacttagagatattagataatctgttctaggtcacccaacatatatatatttaataacagctttattgatatataattcacataccataacattcacccttttaaaatataaaattcagtgggttttagcatattcatgtacttgtaaattaccactatctaattttagaacatcttcatcacccccaaagaaatcctgtacacattagcttctacctttcattccccctcacctctgccagttcctggtaaccacaaatctactttctttctgtatggatttgcctattctggacatttcagtaatgttttcaagattcattcatgttatattgtatatcagtactttgtttctctttgttgctgagtaatattccattgtatgaataacctcattttgttcactcttcagttgatgaacatttgagttgtctccactttttggctattataaataatgctgctatgaatatttatgtacaagtttccatgtagacatatgttttcagatctcttgggtttatttctaggagaagaaatgctagatcatgtggtaactctatgtttaacattttgagaaccgccaaactattttccaaagtggctgcatcattttacaacctatcagcaatgtatgagggttcccatttctctacattcttgttaacattatttaaggtatcctagtgagtgtgatgtggtatctcattgtggttttgatttgcatttcctcaccagctaaaattcatgaaattcagattcaagttcaggtccaaagccagagttttagccactgtgcaataccatctctctcatgctcctagaagtaaggaagaatacgttgataagattgtaacgcactggattgaattttaattatcatctgggtattcacctctagaagcttttaaaaacaagggcttttttgttgttgttgttttgtttttttgagacagtcttgctctgtcacctaggctgtagtgcagtggcgtgatctaggctcactgcaacctgtgcaattctcatgcctcagcctcccaagttgctgggattacaggtgtgtgccaccacacccagctaatttttgtatttttagtagagatggggtttcaccatgctggctaggctggtctcaaactcctgacctcaagtgatcctccagcctcagcctcccaaagtgctaggattacaggtgtgaaccactgcacccagcccggttttgtttttaatctaggatataatagctatggattaaattcagtgatgagctggtaaatggttgacaaccaacttggggtgccacagtggggtgggggtagcaggaggagctctgatttgtaaccactgcttattaccataatgtgaatactcccacccattaccgatttcaagctaccaacttgatgtctgtcagccagcttgcaaaaatcctgaaaatgtaacaatcagctcttgtgaacagtatgagcctgagccagctccaacatacaaattctataaattcattaaggcactttttgaattacaaatgtctttgtacataagagaaaatgaaatgatcactagttacagaagatataattacatatgtagaaaaatctaaagtaattcatgtaaaattaatataagcaatacacaatttcagcaatgggactagattaaatagttatacaaaaattatcttctctcgcaaaaataattagttagcaaatgtgatggtgaagatttccccatcatagtagcaatgaaacaataacagcaacaaagccttagaatacctggaaatacatttaataaagaatgtacagtttctagaagaataaacatcagaaattcttctgaggggcattaaaaaactttgaaaaaaagggaaagatgtatgctgagatcttacaggaagactcagtattatataattattatttcttcctgaaatattttagaaatcaaatgcaatctcaattacaatcccaacaagatatatttagaaaatcaataagatgaatagaaagttcgttcatctaaaagaaaaaaacaaaacaaaaagaggtgaggctaggaaaattttgaaaaataagacaagagaaggctaatttttaaaacaacaagcatgtatttcagaaaaacaaaatacagttaattgaaaagaaaaagaaaaagcaaacagagagagacaggccagctcacctctggagtgcaagagcattcctcagccatgtgttcccttcctcttgtgaaccaaatggaatgaaagtgtggagggagggtgttaagtgactttctgagctgtgttttgaaatgtatttctccttagtaacaatgttataaacagtgccgaggttccaaggctagcccagttctatcataggttaggtacaggcttctaaggcatatcttataaactcaactaccaaatttaatatggatcccactgtatgtgttctagtctccaacttttggaatgcatcgttacagtcagtagggaactacttagacaactaagtataatgaataaagagtattttgagtgtgaatgtggcatgttatggcaatatgttcaatgtttttaattctctttcaccatagacttttttttgatttctcatttgcttatttgtgtaacttataagataattacatatttaacttagcattgtgagaaacaaaattgataacattgctttaatctcctgaatgtataatatgttcttatttctgaacagatacatttttcaagatatggaggaaataagcagtccaatctccactgagctgtatattttttcagatgtttcttctggagtgaatatttacgggctagatagaatttcttgaaaatagacatgtcacattcttgtttatatgtaacatttattacaactggcaagaaatgataatttaaaactaactttaaaaaatgagttcaggacaggtgcggtggctctcgcctgtaatcccagcactttgggaggccgaggtgggcggatcacttgaggtcaggagttcaagaccagcctggccaacatggcaaaaccccatctctactaaaagaaaatatatatatatacaaaaattagctggacttggtggcacatgtctgtaatctcagctacttgggaggctgaggcatgagaatcacttgaacccaggagggggaggttgcagtgagctgagatcgcaccactgatctccagcctgggtgacagagcaagactctgtcacacaaacacacacacacacacacacaggagttcagggaagtttagtttcgaactaatttatagcttgaatactttgaggtaatatttagatcaatttattattcactaattttgttgaaaatttatatcatgactattctgattccatctcaaggcacgaggttactctcagtggataaaaactcagctacagctgaggttattgaaatgccatgcatataagcatcctggctcattttcaatttgcctatgtatgtgggtagggtgtgtgtgtctgcatgcgcccacaatccttaaaattacgtggaatattaacaaataatatcatgcacatccgatgtttgtgcaataatattagagagaaagaagattattctctgagaccctccaagcatcttgctgataactagttttatcctttgacaccacagtttgaggccgcagcagcctgctgacactcaaacagtgagttagtgacaggctctgcagagaacagagcacttctctgtccacagaattccgggcaccaggacgaacacatatgcactgtagactttgagtatttttatatgactcagtataaatgtatacattcatagcctcatgagcgcatgtctgtaaatatggggtctcaatagcttcatgcattttcctcactagccagcgagttctctggcatacttaatcaatcctctactattcttggataggaagtactaaattgctgaggttttaacaaataccatgtttcacttaggcagtgtagaaattatcccagtataagtacattactatttttatgtttttgatttttaacttttattattttaaaaataacataatgtgtattcataatggaaacatataaaatgcagataagtaaaaagaaaaatatacctgatcccaccatgtggagataatagcaaccataataaatttgatgtatacctgatttagacttttttctatgcacttatatacatgcataaaatttttcacaaaaataaatcatatagatgtcttaaaaccttcaaaccctgcttttaaaatttaatataccataaatacctttcaatttccaacataatatttaatggctgcaagccaagaatattttagctgaataggactgggaattctttgccccaaagatcttacattaaattgaaacgtaatcatcccagggcctggcctcctgagggtaagttgtaccactgtggcatcaaaaggtagccaagaggcactgtttaaggtagctgggtgtctaggtgagtgtgtgcatgtgtgtatggtacttcacagtgtggaactgagctgagagtagaaagaggtgtgaactaaagccctgggccaggaaccaaagacaagtgtctgggtttggatagacccacactgccactgagaattctaaatttaatcccatcttccagataattttgaggcttacattttttaaggaaaaaaagagataatattttttatttagtagtttgctttcataactttaaaacattttggcacatgataggtgtattatccttcatttgtacttgaggcagcccctaaaaatgtcaggagcaggcctgaatacacagattatatacttcctaaatttctagaatgtataataattgttttatataataatttacctttctatatgaatgaaaaggagtattacatgagtgctcatttattgactggctaaggttcaatttaatatgatatttattgaaacttcaccatacaccatattctactgggtacaggatgagaggcaaaaatacataggccagacccttacaggactcccagtcttctggggacctcagactgtgaaataattatcccacagagtgataagtgcatcagacaagtgtgaacatggtacagagccacagagagaaaagagtggacaacttcagggtcaggaccctgggatcaattaatttatctggacaactatagcctcacagaaatctttaaaaagctgtataaaccattccatccaagatgagttattgtaagcctttgaaatagttgaacattttaaatttttgataaatttggtaggttggtcacttgacaaattgatcattcaggaattcacttttagtagatgatttttacctaatcagcctgtttctttgaggggctgatctcaaggtacattcatagaaattccgtccatgctgggatttaaaaaatacataggaaggccaagtgcattggctcaggcctgtaatcccagcactttgggaagccaaggcgggtgaatcacctgaggtcaggagttcgagaccagcctgaccaacatggtgaaatccagctctactaaaaatacaaaattagctgggtgtgctggtgcacacctgtaatcccagctacttgggaggctgaggcaggtgaatcacttgaacccaggaggcagacgttgcagtgagctgagattgcgccattgcacttcggcctgggcaagaagagcaaaactcctcaaaaacaaaacaaaacaaaaaaacacataggagtttgaatgggaaggcatgtggtcagttaatgagtaaaaatactctgtgaagagggaacagcacatgtgtcagcttggaggcacatcatggagtggcacattctgagaacagtaggtggttaaaattgctagaggactgaggtgaggaagcaaaaggagacaaaattggagagaaagacagggctacaacctggagggttttgtggtgctgggttccatggagttttatccaataggaaatggaagccattgaaggattcaaaggcaggaagtgagaacatcagactgcattttagacagaccgtgctggcaaaggaatgaaggatgaattgaaggggagtagtctggaaggggggagttcactgctgagaagggagcatccacaagggtcatgataagggcaaattctgaattcagagtgttgagattcaaaactgcttctatgacttagcaaatgtgtgtgtgggcaaagctggtttcctcatctgaaaaatacaataataatagctgtgaagattaaaagaaacaatacatataaagtgctcaaggaagagcctgccatatagctcttaatacatactagctattatttttaaaatgtaatataattattatatttaggagttcaaaagaaagatattgatggtcaggcagtggaggtgggtgtgggaataagaaatataaggagtggatttgacaggtctttttggcgattagattcaagatgaggtaggaggaatttgggaagacaggagcaagaacaagtgggatggtggaagataatgaattttgctttggacatggtgagttttagatacttttgggtcataaaggatatccagtgagcagattgatatgtaggcctgcagctcagtaaagagaagtgaaggccacataagcaaaatgccagggtaagaggttgatcagaaatagctgcactgatgtacaaatgctatttcatctatttggcccttgatgcatgacgtctgttagtactcagaagagagggcaccttaatagctttcttaggtgcaatctccactataaaagctttgcttatcaacccaactaggtagggcttctttactcttacactctttgttatggactgaatatttgtgtctcttccaccccaccaaattcatatgttgaagacctaatccccaatgctgtgttatttagagatggggcctttgggaggtaatgagggttaaatgaggtcttgagaatgggcccttggtcctatgggatcactgcccttataagaagagacactactctgttaacatacaccaaggaaaggccacgcgagcacacagtgagaaggcagctgtctctacaagccagaagagagccctcagagaaacgactctgttggatcttgatctgatgcttctagcttccagaactgtgaaaaaactttctgttgtttaagccacccagtctatgatattttattttattatggcagcctgagctgactagtatatccttgtataaggggttctttgtatttctcctatgggttggtcttttgtttcactctctttattagtatatgtttcttatcacttcttccaccttataggtagcttgaaggcaggtctttccttatacttatgttagcattccctgtggtgccctgcacaaggttttgcccaaaggagatgttcaataaacatttgatgacctcaagataatgcagtaatttctgtgaagaaggtcacagataacaagcttagggcaggagactaggcagcattcaagacttgggctcaggtagaaacggcaagatataggatttcaatgtgaaatttggagattagcaaggacagaggttctcaacaatgatcagtgagaaaagtgaaatggccaacatgtctccaagtaaggcatattcttttttgagtattttgcactttgcaagccattatgtaaaattatgttttggcttggctgcttcaaattaactttgaaaaaaaaattgtttttgagttacagtttgtctaaagcaaatgagtttaaaggctgaaatcgagaatgggtcatatccttaataattttatgtagtaaaagatatttttaaaagaactaccaatcaactgaaaaatccaaaaatccaacaatggcagccactgccccccaaagaaatgaaatgaaacaaaacaagcaaaacaaaaaatattttgtttattgcacttcaaactctagtttattgggaaccacttaaaattgacataatgttcttaagtggagattcaggggtgatgctgtgattctgtgtattttctgcgggatgccaagtgtgttctgggggtcatggtagaaaacagagagggactttgccataaatgtctcaagatatccctctgtgaggatagaagaagtgggggagatttatttatttattttctctggagcatccttcattgccatcttgctaatctcctgagtgctactggaaacaaggactttctagtatcaccagcgctgaagcccaacagtacatgggatgaaaatggagtaaagttgactctaccaacctatccacctaagagaaaccagcacgtggatgaatggatgtcacagcctggagcaaactcttagacttgtgttctccaataggtgagccactagagccacaattggctgtgagcattcaaaatttggtcagtccaaattgagattgagatgtgagtgtaaaatatgcactagatttcaaaaacagttaaaagaatgtaaaataactcattaatatttgcttattaattacatgttgaaataatattttgtatatattaagctaaaatatgttattaaa

SEQ ID NO: 978 - DNA, 3489 bp, Homo sapiens
taaaaaaaaaaaaaatccagaaactaacccaaatgactacactcaaataacaccacaataaagcaaagtatcagcaaacttaaatgttggccaatagtattttctcaagtcaaaattaaaaaaaaacaaaaaataaataataaaaaaagcagatcctagattacctctgggattgtattaagcttcctgatatatgtataactggagtcctagaagaaaatgaaaataagaaaagggcagtcaaaatacaaacaatacagtagtcaaagtttttcatactgtaaatagatagataatattcgcagattttggaaactcaccagaatacaagcaagataaatagagaggaaaccattactgagcactgcccagtagaaatctgggaattgagccactgttctcccacagaatggtagattcacagcattaggagatatacctaatgttaaatgacgagttaatgggtgcagcacaccaacatggcacatgtatacatatgtaacacacctgcacattgtgcacatgtaccctaaaacttaaattataataaaaattaatttttcaaatttatctataaattcaaggccaccacagttgaaatcacaatttttttttgttgttgttttgttttcatttggctttttagaggcattttcaattctattctaagaattctatgaaaacaaaaatttctaaaacatctgctctaaaaaaggtggagcaaaacttcctaacccttaagtggcgtgggttacacatagtgacattcattcaaagtgtactccctgaaattaaaactctcaaaatctgggtacaggagaaacataatataataaaagccatatatggaaaactcaaagctagtatcatactaaatgggggaaaattaaaagcctttcccctaaaatctggaacataataaggatgcccactgtcacttctgttattcagcatagtactggaagtcctacttgaataatcagacaacagaaaaatacaaagagcatccaaattaaaaaataagaagtcaaattgtccatatttgccgatgacataatcttatatttggaaaaaaaactaaagattccacaagaaaacttttagatctgctaagcaaattcagtaaagttgaagaatacaatatcagcatacaaaaatcagtagcatttctgtatgccaacagccaacaaactgaaaaagaaataaaaattaagcttattaacagtagcccaaataaaattagtaacaaggaattaactaaagaagtgaaagatatctgaataaaaactgcaaaacaatgatgaaataaattgaagaagacacaaaaatggaaaaatattccatgtttatggattgaaagaaggaatattgttaagatgtccatattatccagtgcaatctacagattcaatgtaatccctatcaaaataccaatgacattctttatggaaatagaaaaaaatctaaaatttatatggaaccacaaaaaaaaaaactcagaatagacaaagatactctaagcaaaaagaacaaaattgtaagaaccactgtacctgatgtcaaatgatactacagagctatagtaaccaaaacagcatgttactggcatagaagcagacacatagaccactggaacagaatagataaccagaaaacaagtccacaaacctacagtgaactcattttcaacaaggtgccaagaatattcactggagaaagaacaatctcttcaataaatggtgctaggaatactggatattcataaccagaagacccatatgtttcaccatatactagacccatatgtttcaccatatacaaaaatcaaatcaaaatggattacagactttaatctaagacaacaactggatgaaactggagttaattatattaagtaaaacaagccaggcacaaaaacacaagcatcacatgttctcacttatttgtgggatctaaaaatcaaaacagttgatcctatagagatagaaaatagaacaatgattaccagaggctgggaaggggaaagaagggagggtgggggtggtgtggagatggataataggtacaaaaaatggaataaatgaatgaataaggcctagtatttgattgcacaggagggtgactatagtcattaattatttaattgtacattttaaaataactaaaagtataactggattgtttgtaacacaaaacataaatgcttgatgggatagataccccgttctccatgatgtgcttatttcgcaaaaatgtcttatgcaccccataaatatagaaagctactatgtacccacaaaagttaaatatttaaaaaaacaaagaacactgtattgaaagatagaaaaaaatgggtaaatttaaagtggaaaaacctgataattattacctcatccagttaatcaaggttagcattaattatgatgtcatgcagatagcatgggtttttgataaaatgtgatgagaatggcacttcacctttctgtccttcatatatataaaatatatgttttttaggattctgacaagtgtgtacatattttatatgattacatcttcaaaatctacatcccaaataaagaacattaaatatatatgtgtatattctaagaatgagaaaacatcctatacactcagttgagagacattttataaactagttggccagcagtctaaaaactgaaaattttccaaaacatgagaagtcaagaaaactatcacagtctacaagaggctaaagggacataacaaatagatgttatgtaacatcatgaacattatcctgaaacatgacaaagcaattagatacatctaaggaaatttgaataaagtatgaaccgtagttaaaaatgtaggtatcaatgttagtacattagttgtgataaatgtactgcacttatgtaccatgtaaacaaaaaattggggagtgagtatatgggaactctctattcctctgtgcaactttcctgtaaatctaaaacgacaatgtcaagtgctgctgaagatgtaaaacaacaaaaaaatatgttgcttggaactgtcctatagagtcaaatatataccaacaataaacccagaaattctagttggaggtatttacccaagaggaatgaaaacacacaaatatgtgtacataagtgatcagagcgactatgttaggaactttatacacattatcatatttagttattccaagatgcttgagaaaaaaagcaatcttatcgcattttctcagaaggaaactaaagacatgatgtttcaatccacgttcacgttgaaatgaagattttacacaaagattgtaaggtcttgtaaggtctaccataagcacaactttattccagaaggagaagagataaataatagggcaaaagcaatttttgaggagacaacgggcctaaaatttcacaactgataaaatacactaatctacagatataggaagttctaagaactccaagcaatataaatataaagaaaattcattta

SEQ ID NO: 979 - DNA, 2185 bp, Homo sapiens
agagctccagttgtgtcttgttgtctgccaacgctaactggccagctctgacaggaggtgcgtggcccaggaggagccatcaggccagttctctgggatactgctgtgtctccagctctgcagtttgctcttcgtcactcagcggcagacggagaggcagacacgagccccttgtgagccctcctccttaccgtcatctcacaatgctctgaaataaggaggcaaatggctgaggtcccctcagttgtagatgtgattgagttctatctaccagaagcatatgcctcctggaagcctggttctaacacctcccacaaaatccttcaagcacttttttctgttccaaggtttgcttatgggggacccagtgaagtgcttcagagccctagagatttgctgagtcatatgaggggtcagcaaacttttcctgtaaagggtcagataataaacattttaagctttgtagactgtataaagtctctgtttcttctccccctcctcctcctctttctccttcagcttctttcctttaaatatgtacaaaacctttcttcttttccaaaatctgtctatatttgacctgtgagctgtagtgtgctgagtcctgcattagtaggaaagatcttgagtttcagaatgacgatgtaaagcagagaccctcctccccgcacccattctctgcaaccgacacttggattacttttcttttactctttgtctttctctgaagtatagatgtatggttggctttctgaggtcaaatataattaagaggtagccaaccatttggcaaatttgaaccaagaagagttctgatataaagaatgtaggacccattcactcccaattagtctcttcactgaaaggtggcttacaccaggtatatctcatttgctaatttgcttagtccatgtctagggaaccattgtgatcaagccaatatacccaggccagagcagcctgctttagaatcaaagctttaggctaggcgtggtggctcacatctgtaattccagcactttgggaggccgaggcggacagatcacttgaggtcaggagttcgagaccagcctggccaacatggtgaaaccccgtctccattaaaaatacaaaaattagccgggcatggtggcgggccctgtaatcccagctacagctacttgggaggctgaggcaggagaatcacttgaacccaggaggaggaggttgtagtgagctgagattgcatcactgcactctagccttgacaacagagtaagactccaccacaaaaaaaaaaaaaaaaaaaaaagaatcaaagctttaaaatccagcagaagtaaaatttccaagtgggagggaagaggatcaacaggagaatctgcaagagtaaaagaggaagaagatgtgtgctgcatggcacaaaatgaatctgcaaagcatctgggaactgcagaccctactgatgcctggaactcactggagtcagcatgtccaggcagtcattgtagcaagtcagagtggtgtgatgaaatgcttcaggagaaaaacatttcaccacagcctggttcactcagataccttgccagggaaccaacatctcactcgggcctctgatattgtaactgtgggcctttaagaaacaacggaaaacccaactgaataaaaactgacctcctttgtggctgccctgatggaaggggctcaggagcaacagccttcatggtgcccaccctctgggccagaacaacggatgccccacaactgagtttagtgcctccaagaaccacagcttttttttgcagcagtaagagcatacctctgaggcactgtgaagaatctgatagtcgaactgaatgaagccaagtccagtctttacggaaaaatttacacaacacttccaggtgggcagattcaaagacaggatgaatcatggttcagtgcagtggttcctggctgtaatcctagcactttgggaggccgaggcagggggactgcttaagaccaggaattcaagacaaatctggggaacatagtgagaccccgtctctacaaaaaattttaaaaaattagccaggtgtggtggcccgttcctgtggtcccagctactcaagaggctgaggcgggagggtcacttgagcccaggagtttgaggttacagcaagctatgatcgcacatcactgcacactagcctgggtgacagag

SEQ ID NO: 980 - DNA, 2580 bp, Homo sapiens
ggaataaaatacagaatttagtaaagctgaaaactacattgttgaattagaagacaaatttgaagatattatttagaactgctttcctttgtcctgtcatttctctacaaagttattgttcttggttgaagatgctatatgagcaggagttttaagctactgctttgagctattctttgttgaggcttctcctgcatgatatgcactgcacgtattaataataataataattaattctcttgtgaatctgtcttttaccatgaggatctgtcccaactaagcactaaggataggtacaagtaaatttctgcctcccctacagtgggcagtggcatggggagccagagacactatgtgttccttctgcttgggcgtgggtgtcagatcaactggtgctcccacagcaatgggtagatggaggctatgcaggagctggtactctctatgggaaaggtcaagacagctggcagtgctggtagatgaggcagcatccagtagaaaatgggcaaatgatattaatagtatttcagagaagaaaacaaatggcctgtgaatgtattttaaaatgaccaaacaatatctgaaatcaattaatataatacacctcagcaattccactcctaagtgtatagccagaaggaataaaaatatatatccacacaaaaatatgtacatgaacgttcatggcaacattattcattatagctaaaagtagaaacaatctatgtgttgtatttctttataacattcaaatgatgaatggataaataaaatgaggcatatccgtacaatggaagattattcagcagtaaagaagaaggaagtactggtatgcactaaaacatgaataaaccttaaaaactttatggtaagttgaaggagccagtcacaaacaaccacatattgtatgattccagctataggaaatgtccacagtaagtaatctatagagacataaagtcatcagggcagaggaacttgagggggactgagaaataactgctaatgggtacagggttgctcttgggggtgatgaaaatattctaaaattgtttgtgatggttgcacagcctgcataaactaaaagccattgaactgtatactttaaatgagtgaattgtaaggtagacgaattatatcttaatgaagttataaaaaataaaaaataaaaagtgctcaacctcggctgggcgcggtggctcatgcgtgtaatcccagcactttgggaggccgaggtgggcggatcacctgaggtcgggagttcaagaccagcctgaccaacatggagaaaccctgtctctactaaaatacaaaattagccgggtgtggtggcacatgcctgtaattgcagctactagggaggctgaggcaggagaatcgcttcctcaccctcccaagcagctgggattacaggtgcgcgttaccacacctgggcaatttttgtatttttagtagagatgagttatcgccatgttggccaggctggtcttgaactcctgacctcaggtgttctacctgcctcggcctcccaaagtgctgggattacaggcgtgagccaccacgcctggcctgaccacttttcaatgtctgtagagaaatactgttagggtcccctgaaagccaatctaagtctgtatttccagccttcactcagttcttctttgtaaatatcctgcaggcacctcaaaatccacatggacaaaggttaattcaactttcccacatcctattacatgttctactttccctattccagttaaaatccaagctaggaagttcaaagccaccttccactttctcacctccaaacacttttgccatgtagcttatgtgagttgtctcgatttagcttgtttttttctcatttatcaggtaagcacctttcttaaatttgtggtgaaggtcaaatgagaaagcatgttggagaatgttccaaacagtgccttgacaggagcaaacgctcaggaaacagtggtggtttcatgatgatcccttgccagaagactgcatggactcctaatccatcttcctgggggcagtacctccccattttttccccttggttattctcttctctcttcagggccccagttgtgcacagtatataatcatttgtctgcagaacttttcctgtccttgcctcatcattgtgtgttgagtgtgttgggggcagataacttgtctttttagttcactggtttccagatggagagaaggcacatctgagcacacacagaaacatggggaaccgcatcccactacactagcagctgactgagatgactagaccctggactttgagcagatgccataataggatgtgcccgtggaggcggttgatgattagtgcagtttacatgtgagaggaatgcgaattattttaggtaggaggtggagtgtactagatggtttccaaatatggctgcatcagtatctccaatcccacaactctttgcaaggtgattttgccacttgtctccttaaaaggtggagtctaattcatctcccctagaatttgggctggctttgttacttgctttgaccaataaaatacggcaggtcttatggcttctgcttaaa

SEQ ID NO: 981 - DNA, 2788 bp, Homo sapiens
agcgttggtacgtgctttggtgcagggcctcttctcgagcgctgatttccagggtgctgttccagatgccatatccaaaataaatgagcagacctgtggggcgaggggaaaggtacagataagtaaactgaggcccaaagaagttaagtaaatttcccaaagtcacaagacaaaggaggggcagagctgtgatttgaagttggtgctgtttgactccaaagctgcttcagttgtcaggatgtttacacggaagaagcactggaccagttatgctgggctcctgtttctactccatccctgtagattcagcatccttgtttctaaaataaaagtattacaccaaagactctcttacggatctcctaactctgaccctctaggattccatctgttatattgaactttgtagtattttttgctgcaaaatctgttgagcacagcttagcttttcttttacatcagttacaatattgttcagtattatggagatgctgtcagggatagtgaagctgtttgtctctacattaaatggcccagtctgttatttattttgagttcctatgtcagccctcctccccttgctttgtaaatgtagctttccatctccttccttgatgtcagactgtcagtttttacttcttgttgctgtcccagtgcttacctggagcagtcagactgcctcttttctaaattgctgcttccaacacctgatatttaaattgttagagtgagtctaaaattaagaggaaatggtctttgaagaaggcctgaagaactcttccatggggaaagtatagagtgtgcacgcattaaatacaagaacctgatgatattttcttggatgccgtgtgttttcagggttctcgggagttgagtttgcacatacggattaggttgctctttcagtgatgtgtgaggaaggaagtgaagatgcaactcacttccctgctttggtattggatccacagcattatccaattactcctatattctatgagcttattctcatcacccaactttaccacctgatattgtacaagatttataagtaaaatcttttccaaatgatgcttttgaagcaggcatcgatttgattgcaaatttaatttggagagccaatatttatggaatttgtgcaatcaaacattctctccataacattcgatctgacaaattaaatttaaaaatacccccattttgccaccagaatacacttgccaagggtaattagcaaatggccaagtcttcattaggtcttgtgaatggaccagtccattgctgtctgaatcagagaaagaggccctggctgtgcatggtataaggagcatttggaatcttagtcatttcccaaggtcctgctggggtcctaatgactgtagtttggggagaacactgggaaaatcaatcaggcactaaccatacaagacaatttctgcttcacgaaatcgttgttttggacacactgtaaaagatcttataatattttaaaatctttctgatttgtttgtatggagaaattcagacttagagtgggtactagagagcatctagcctggcattgaagctcactggtgataattgaatgtttacagcctcaaatatcctgagaaaaatgttctcattcaactattttaaaatatctggtatgtaagaggaacacatttaagagtatctttctaatttcaataagaaattaaaagcatggaaatggaattttattttatttttttaattttttttaaatttttttagatggagtttcactctgtcgcccaggctggagtgcagtggtgtgatcttggctcaatgcaacctccacctcctgggttcaagccattctcctgcctcagcctcccaagtagctaggactacaggcatgcaccactatgcctggctaatttttgtatttttagtagagatggggtttctccatgttggccaggctggtctcgaagtcctgacctcaagtgatcctcctgcttcagccttccaaagtactgggattacagcgtgagccactgcgcccggcgaaaccttggtttttatcctagattatctagggtcctagattactgagtgttgaggggcaagttaccctcttatggatgaaatgagacggccaattagatacagtttagggtcccttctgatgcatcattctttggttttacagctaaagtcaactcttaatcatctagttagtgagggaagccctgtaggaaatactgtatgaaccaatggttctcagtgaaggtggtactgactcctaggggaattttggaaatatgtgggagtgtctacggttctcatgatgattgtgggcacttgtggcattaagtggacagggacctgggctgtttatcattctgcaatgtgactgactcacagaatgaagctctgtcttgtatcatatatgactgctgatggccccagtggacattcatttaagtacaaacctgtttataatttttgaacttgaatttatctccattttacatatacacacaaagcatttttttttttgcatggctttttagacattgaattttccaggactgcaacagctgggtaaattgagagacagttgtctcttgtttggtttggaatttaccgacttgatcatcattttggaagaccatcatcaacaacaatgttattcatggactttgagcatcaaataactgtcctatatgagtctgcatttgtggcagttgtactcacagtggttctacaaatgactgcaaacaactgacgacttcgttgcgtctcctaatgtacgcatgcccca

SEQ ID NO: 982 - DNA, 10481 bp, Homo sapiens
tctctcagtaatgtgttataattttcattgtataggtctgacacatttttctctaactctcactgcatcccaaatggaagggattggttttattttgcaagatatatacattaaaagtgatatatacattaaaagcaacaataactaccaagtgtacttttaccatcttttcctaaaaggacattttaatgccaaagaaacagatggcatgaggtcagagcagtaacagtggctgaaatctacctatttggcacccacgccggctcctgttctgaggagtcacgaaaactggaaaggcagtaaccctgaggccgacaaattccatgttagttctattccacctccagttcaccctgtattcctctcatctctatggcagacagaataatggcccaaagacatacatggcctgatccccagaacctgccacatgctgtctcacaggccaacagggactctgcagacgggaaggaattaagcattgacacggggaaactatcctaaattttcctgatgggctcaatgtcatcacaggcatcctatgaagtgaccacaggacctaagagggtcaaggtcagaggagagatagggagacggaagcagaagttggagtgcagcactctgaggacagaggaagagccatgagccgaggaatgcaggcagcctctaggacctggaaaaggcaggaaacggattctcctctagagcctcaggaaggaacgtggctctgcaaacaccttgattttgggcggtgagacccattttggacttctgacctccagaacgataacagatgtgcgttatttgtaagctgctgggtttgtggtgatttgttacaacccactttagggaacactgacccggaaggagggtgaggatagagaagccagagtcagcacagaggtgctgggaggcgggagcagaggaggggcgagctgtatcccagacagtaagaggggagagtgtttgggggctggtcaggctgcataagaaggcagagggacaaggccactgagttgggtggcgcagaagccaagtggcagccttgacaggagctgttccctctggaagaaaggaaggacccccggctgctgtggactgaaggcttttgctcgctttgcctcacctagatgccccctttctgctgctacatcccagcacccagcaggcactcggtacacacctacgatgaacacccgactgctctgactcttcaccctcccaccactggtgactccagcctcactgctaacactcccttactcacgggcccctctgctgctcgaggcgcctcagggcctttgcactggctgttcccgtggcctggaccactcttctcagaggtctctgcgtggctgcccgctgctcatcacccaggccccacacagcccccaccgggcacgtgagagtgtcaggtattgaaaggacaatattttgaagacattagggtcaacgagcagattatcaaaactaaattcacctgtttcttttcacttttttttttttttttttttttgagacggagtctcgctctgtcgcccaggctggtgtgcagtggcgcgatctctgctcactgcaagctccgcctcccgggttcccaccattctcctgcctcagcctcccaagtagctgggactacaggcgcccgccaccacgcctggctaatttttttgtatttttagtagagacggggtttcaacctgtttagccaggatggtctcgatctcctgaccttgtgatccgcccgcctcggcctcccaaaatgctgggattacaggcgtgagccaccgcgcccggcctcttttcactttttttaacgtggcgactagaacacgtaagatggcgtctgcggttcaccttacacatcctccctggagagcgtactctaaaccaggatgcaagcttcccctacagggcaagacaggaaatgcttccagcttctcaggctctctgtcatagtcacggtggcaagagtcagccacagatgacgtaagtgaatgggtgtggctgtgcaccaagacttcacaaacacagttgctgggctgggctgggcgggccccagacagtgagtcggcccatacctgctgtgtgaaagaatccaaacctggggccgggcgcggtggctcacacctgtaatcccagcacttcggcaggccaagattaggcggatcacctgaggtcaggagttcgagaccagcctggccaacaatggtgaaaccccatttctactaaaaatacaaaaaattagctgggcatggtggcgggcgcctgtaatcccagctactcaggaggctgaggcaggagaatcacttgaacctgggaggcggaggttgcagtgagtcgagatagcgccactgcactccagcctgggcaacaagagcgaaactctgtctcaaaaaaaaaaaaaaagaaaaaaaaaagaaataataaaaaaagaagaatccaaacctgcccagagagaggcctggcttttgccctccgccctcgggaagtcatctctgagcccttggtgtctcgcgcatgaggagggtctgactgcctggggccctcaggccagcccgacagcaagatggatttggggtggagtttgggccaggtggtatccttgagcttccggggctggaggctgaggtcagccacacagatcggggaggagtccccagtaagaacccgggacaccaagatctgaggagggtccctggctggcaacactccctgcgtgccgggaggagtgaagggagaggacagctgataactggtctccgtggagccttccgggccctcttcctggctgcttccagcgcgtccttctctgtgataagccgtgactgtgaacatggctggccaccgcctcctcccagcttagcggctgacggctgcacacccaggcctgcgtgtcggctggcagcgcgctcagaaactgctccagcaccagcagctccagcatctgctccttggtgtgcacctcgggccgcagccggtcccggcacagggcgcgtagcagccccagcgcctcgtgcgggcccggcgcctcgcccaggtggaagcggcggaagcggtgccacgaggagcccagcgccaggccctcggcctcctgcttcagcggcaccgtcagctccatggggcctcctggacggcagcgcctgccccgcgtggcccagggtgcaaagaggtctctgtgaggggcggcgctcactcgggcggtgaggaaagggtgtctgtctcgtgggatcccacggagtcaagtgccggctctgcccctcgttgggccccttccgcggcttctgtacctcagtcctgcagctcctcccgcagcctgtcctacagcacaaaggctctggagcaaattccagctctgcctcccaccagctctgtgtccttggacaaggtacaaggcaccttttgtaatacactgtctctccatgtccttggctcactctctcaggcgaggcctcccaagcctctttacctccgcgcacatgtgcacagagctcaccggaactcctcttacacatttttgattattcgttgctggtacctagaaatactatttttgtgtattgatccttctagccagtgactttgcagaatttacttattaattctagtagctttactttagatgacttagggttttccatgtatacgatcatgtcttctgggaataaaggcagcattatatcctccttaccaatttcaatgccttttctctcccttgccttgctgcattggctggtgtctccaatagagtgtcgaaaagaagtgccgagggtagacattcttgcacagttcccaattttagaaagaaagcattcgggctttcaccatcattaagtgtggtgtcaaccttgagtttgtcacttacaccctttatgaggctgaggaaattcccttctgttcctaaaatgctcagtttttattacaaatgggtattaaattctgtcaagggccgggcgcagtggcttacgcctgtaatcccagcattttgagaggcctaggtgggcggagtttgagaccagcctggccaacatagtgaaaccccgtctctactaaaaattcaaaaaaaaaaaaaaaaaaaaaaaaaaaagccaggcgtggtggcactggcctgtactcccagctacttgggaggctgaggcaggagaatctcttgaacccaggaggcggaggttgtggtgagcggatattgaggcattgcactccagcctgggcaacagagtgagactcgatctaaaaaaaaaaaaaaaattctgtcaaatgctttttctatatctgttgagatgatatgatggtattgacaggggttttccccttcattctgttaatatggtgaattacattgatattaaaatattaaaccaatcttgtaagtcagggaaaattgacacttggttatggttatatatatatatatcttactggatttgatttgttaaaattaaaaacttttctttttcgaaaccactttattggcctggtgcagtggtgcacgtctgtaatcacaggactttgggaggctgagttggagaccaacatggacaacatgacgaaactctgtctccactaaaaatacaaaaattagctgggggtggtggtgcacgcctgtagtcccagctactcaggaggctgaggtggaagtcacttgagcccaggaggtcaaagctgcagtgagctaagatcccaccagtgtaccccagcctgggagacagagcaagaccttatctcaaaacaaacaaacaaaaaacaaagcaacaacaacaacaaaaaagctgctgcagtggctcacgtctgtaatcccaacactttgggagcgtgggggggggcggggggggtggatcacctgaggtcaggagttcgagaccagcctggccaacatggtgaaactctgtctatactgaaaatacagaattagccaggtgtggtggcacacacatgtagtcccaggtactcgggaggctgagacaggagaatctcttgaacccaggaggtggagactgcagtgagctgagattccaccactgcactccagcctgggcaagacagagcaagactctgtctcaaaaacaaaacacatacacacacacacacacacacacacacacacacaaccagattattttattgagatagaattcatatgccatacaattcaattcacccacttaaagtgtacaattattttagtatatcgtcagatacacacaactatcaccacaatgatttttagaacattttcatcacctcatgaagaaatcctatacttttctctttattttgagacagagtttggctcttgttggccgggctggagggctgggattacaggcgtgagccaccaccgcacctggccagaaatcctatactctttagctgtcactgttgaccctctctccccgaggcataaacatccactaatctaccttatcttcagagtttactgtagagattttattaaatgaaataatataaaatgttatctttgcgactggcttttttcccttagcatgatgttttcaaggctcatctgtgttgtggtatacagcagtacttcatttctttctcgatttgaataatgttccattgtatgatctaccacatactgttcatccattcatcagctgatgggcatttaggctgttttcaccttttatctattgtgaataatgccattatgaacattcctatacaagtttttgtgtgtacatgtgtttttattaccttgggggtatgtatctgggaatgaattgctgggtcatatggaaactctgtatttaatcaatgagagaactgccagattgttttccaaagtgactgcaccaatttatattcccatcagtcatatatgagggtctgatttttgttttctcaccaacacgtacctttttttttgacacagggtctcactctgttgctcaggctagactgcagtgacatgatcatggctcactgcagcctcagccttcctgggctcaggtgatcctcccacctcagcttcctgagtagctgggacttcaggcacatgctaccacacccagctaattttttaacatggtttagagttaactgtttacttcctgggagtggggaaattttctctttatcaaaagttggccctaatattctaagagttataggtaaatgtgaatcaatatgtcagttccccatctccccgctcatctttcttaactttgtagcttaatgacatgaatatacagagcgaacagactttggtctaaatatcaaagtttattgaaataaaatataatctataataaaaaatactacaggtgttattcactggttacagttttaagtatattaacaaaaacagccaacattttaacccaacaatgacactatctttgtggtacaataacaaacatgaaagtaaatgttgaataatactgaataattctgtcagaaatattttatactttaccatctatgtatgccttttaaggaatatcctcccaaagtgaaagttttgaaactgatgacattgtttttaagaattaagtagttttaaaataattagtatttaaaacaaatttatttcacagaaattcagttcaaccctaagctgggtagatggttttaggtatctttatgcaaaaaatgtatttcaatgctctttcctatgaatctctagggttgttattattcctcaattgaaattaaagctggtcataaagcaaaacagatgaattatttcagaagtaaaatgggtattaagataaaaaatgaaaggaggaggaaaaaataggcactcatacgtaatctatatattaaaacgctttgagaactcagtagccagtcttggcctggcacaaagagatctttgatatgtcacagcaaattgacccaattagtccaacaataaagtggagaaagaaaacttgtttctcttccttgctatatttcaagataattttctctgtagtcattataccattccacttgctactcctcaaaatatgtgcctcaatccaattattctgcacaattcaaggaaaagattcacacgcactagctttaggaaatgactttcagggtacctctgaagtttcacaagcaaacatgattccttttgctgactgttttgtagcattcacacaccaatctcctgttatactgtcctacttgtaatgtgtgaatctgtaacaagctgtcatttattaagcaagatagtcttttaacaaaaacctctgagggcttttcaaaacctcatctttaaaaatctgtaaaacaaagataccctatgtaccctgaaaaaactgcttatttcacatatgtgaaaaacaataataaaaattctgacaaaattgagagacatacaagacaggtcttcaaggattaaatactgtttgtcttaaaacatgttgcaattatgttcacaatgtaaggttcattaaaaatttttaaaaaacacattgcattagttagaactgctttgtaaggtatttcagttacaaggcctattttgacagatcactgatttgagaacttaaatgggaatttcagtttcttgacttttttttttttttttttttgagatataagagtctcgctcagtcgcccaggctggagtgcagtggggcaatcttggctcactgcaacctctgccttccgggttcaagcgattcttgcgcctcaacctccccagtggctgggattacaggcatgtgccccaaagtgctgggattacaggcatgagccaccgcaccgggccagtttcctgactttttattttcagctataaaacaattatgagagccaaaggagccaggatcaccttccaaaacattttgttttgtccttctctaatttatgaggcattctttcttctcaaagcaggatattacagtgcagattaaaactggatattaaagttaatggtgacaaattattaagtagtttgaagaaatccttagaatatcagataaagagagacttaatggcagaagaagaagtctactggggttcaaagcttaggttttatatttctgccatggtatctcaacactttctctgggatagtacgatgccctaaaaaatacctgtgttaggcagacaagtctaaatctcctttctcaggacaataggacaaaactgaacttgaggcaatagttgaagaattttaccccgtttttcaagtttaattttcttgagatcagaaaagtaaaattagaaagtagaatccttcatgtaaaaaaatatatgcgtatcacaatttattaaactctaacatctaagagcaaaaacaccaggattaagtaagaacatgcatgaactaaaatttagatagatattcaaagtaagttaaatttaccagagtcctgcatctggcctctcccatgccattatcgctattttgcaatttgttttgttcaggaagcctctgattttaatatttaaagtgtcacctgagaagagtaacctcaattcttcatgttttctcaacaatcttagaggtgttggacatcattaataaaatatactaaattatcagagaacttaagaacgctaagattctgatgagttcctttaccattttcagtcactttctaaaagggatttaacttcacattatcaaataacattttacactaaaaacacaatttatatagccctaaaataatattacttgagagatctaaatgaattccaccaatgcaaacgaagtttatatactgtattagtaatttgataccaccgtattccatggagaaaaaggcaaagagaatctaaatatttagatctgtgaaagatactagaaaaaaatagatttttaaatgcttctgatcctctcaaaatactcttgattttgactctatagtctatagaacacacaaaaaactgtaaaatgcatttgggaagagatcacgccatactcaaagaaaattctacaaattttgacagcattaaaaaaactgacttaagatatattttgttattgagaaaaaagtgtgcacattcaagaacataggatgtgtaatatttgtgataaattaagtcatactttgtgcttatactatgccctttattcaggagtgcaaaacacttaatcaaaaagagcatccttcacatatttaaagagtacattgaggcacagaaagtttgcccaaggcaagatagaaagtcgggtttatagacacaaaatgatctagaattcttcatgtccaattccttaaaatacaaactgtagactatttgtaatgcctccatcttattttatcaaacattagtaattttactattataagtttatgcataagtactgtgtgataggtaatgcccataaggtttttatcatgttttaaggtaacttgtgcatggaataggaaaagttaatcaaatgtaatcaattcgcttttgctttttaacaaaacttaaataaatgagctatttgaggacagttctggaaattcttgccttgatttttctccaagattttagatatgtagttcacatgtgaacattaatatatgaacaattattttatttattggcctctagttctctttcctctcatgatctgtctcttagtgaattgactttctgattcattgaaagcaaaatgctaagaaggttttgtgcaagtgcaaaatgtttaatcttgggttcagtcaactagtctctgatactaacttgcttagttaagccaagatcaagaagtatgagaaagaacttgaaatatgataaagaatttgaaacagaatatgggataagtagtcaatatcagaaatgtgagacaataaaaacaagatatattccaaagcctaatcctaaatttaaatctacacttcattcaactctgaacctgaccttgaaacatggaagaagttactttacctaagcacactgcaccagtgtaaaaccaatgccaattttagctgctttatactgcttaatgtgtatatgtacacatgtattcttaaaatggtgattcttaaattgaagttctgaattcttttgagaatctaacagaggtcatgaaaacttgcttcagaaacacacatatgtaaagtacttttaagtgttgatcatgtactataaatcacagcattgtggatgcaatgggattagacatgaagaaaaattttatatttttaataaagactggttactaaccttaaggaatatacttagactctgaaagtaaaaggaaagtgcaatgaccatatttgttcattcatctgcctattttcaaatctaatgatgatttggttgatgcaaatatgtccctaatctaggctataaatgataaaaacaaaaatgtttaagttctaacttttgttagcagtatacatctaagaattttcaagtattacaaaatacttggaaggaaagactttaatataccactttcaaaatcctatgtacccaaaccagcaatgaagtggtgggatatataacgttaccttgggcaaaatttaagaaaataaagacacaatagctctaattttttttttttttttttt

SEQ ID NO: 983 - DNA, 1480 bp, Homo sapiens
atgctactcatgcacagtgctgtagtcctggggctaccatcagcctgcagatcaggtcaactccttcaaggctctgcattagggcctgctctaccaataattcatttcagctccagcctcaacttgtctggtgttaactcaggcactaggggatggacagtcatggagaacttattaagcctctgtgcagggtcagcctatcatgactcttaggtgtagggctgctcaggagtcaccaagcatatacgctaaggaagaagtgagttcacacagcagccctgacactgggatgtgggtgactgtggcctgtaagatctttgatgtcagaatttgtacacctacaccaagcaggaggcatcaaaactgacccttacactgatgattcaatgcatcactcaactctgaaagtcaacagctaggtcttctttaatgcagaggccccatcatcatcccccaccccacaccctctccagctgcttatggaaaattacatcaaacccaacccagtcttcactcagaaccatctgcctgtacctagcctggacccaagcaccttttgcctgcatgtagtagaggtaccattgggtcagcagctgttcctgttccaggagaaacaggagttcaagttccctaagcaccggatcatactctgcagcataccagcaactggtgctctgagatgactcacgtcaaagaagtaaaaagtctggagtggaggatagttatcagcactgcacatgggaatggggcacagctctgtaatatgttagccttggctggtcatcagctctgtgaaactgaggcccatgtctgctttgagggagtagactctgaccccactgggactgcatatggatcattcctctgtctcaggccatagactctgaagctcagtggcatatgaggtaaatgggcagcctctgcctggtgaccataccctccattttgggtggtggttcccactgtggtgggtgcacactctgtcaaatggctgggcaaagtgaatgaatgtggagccagaagaaagatacagccactggcaacagtgggataacaaaagcttctttccacatgtggactgggacactgtaggttttgacttggttccatacattcaggaacttcttggccattgcagtaccctaaaggagggagactacagagttaggggaggtgaccaacaagggatatacatgaagtggtggtggcagggctattatctgggggtgtgagtctctaagtgggacctaacctggcaggtggctgagctggatggagattaacagtgccacaagagggcctgggcctggtgtctatggcagccgtaagcacctgtgccagataggcagaggaattgaacattgtttgcaaggctgtggatggcagctatgatgtgcagctatactccagtgtcccaatctggagcctctgaggtgtgctcagcaatgtctggcactgtgtccacatccatgtggcccca

SEQ ID NO: 984 - DNA, 10031 bp, Homo sapiens
acagtagggaaggtgcggagcatgatggtgctctgtaggagcgcagacgctgaaaggcgcgctgctgtggctgggagaagagcggagccaggagtttgttcccaatatcttagtgctatggcaaaagaagggggaggagtaattgtggggccccccacacacccgctgcggcgatacactcaccctcgccaaagtccttccggaagtctaagttcgaagatggcgccgcctgtctggtcgcggtcttatgacgaaatcttgttagctgctcttcactgacgcccccaccccagtgcacaaggtaaacacgtgtgcttggtccggagtcggtgccgggctagttttctcttagactctgtattccataatgcagcgcggccagagtcaccgagccctccgaagccagccgagttccagggcgtcttcagcggcgccagggacgctgcagggcctcatgggagttgcagtgtcaaaaaggggagatcgacgcctgcgcggccaacgggatcccacgcggcctcgacgggagccgggagtaggcggactcccaggccgggctcgcgctctggatccctgaatccggcctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaagtcagggatgggcccgagagagcttggaaagaggacaaggaagggaaggagtaggagtagaaaagcatgactttggctgggtatggtagctcctgtctgtaatcccagcactttgggaggccaaggcgggggaggatcacttgagcccaggaattcgataccagcctgggcaacatagtgagaccccgtttttatttttatttttattttttcctgagatggagtcttgctctgtccccaggctggagtgcagtggcgcgatctcggctcactgcaaactccgcctcccgggttcaagcaattgtcctgcctcagcctcccgagtagctgagattacaggcgcccgccaccaagcccggataatttttgtctttttagtagagaaggggtttcactatgttggccaggctggtctcgaactcctgaccttgtgatacgcctgcctcagcctcccaaagtgctgggattacaggcatgagccaccgcgcccggcctaattttttaattttttctagagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgcccaggcaggtctcacactactgagcgcaagcgatcctcctgcctatgcctcccaaagtgctgggattacaggtgtgagttgccatgcctggcccggttatctttctaaagcataaagcaaccctgttgatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggccaatgtggtgaaaccctgtctctactaaaaatacaaaagaaaattagctggatgtggtgacgcacacctgtagtcccagctactcgggaggctaaggcaggagaatcacttgaacctgggaggcagaggttgcagtgagctgaaatcgtgccattgcactccagcctgggcaacagagcaagactccatctcaaataaaaaaaaaagaaatacaggacatagggaatgagtgaaatgacaacataagaaagcaaacagtcaaatctagaatgcagaacatttcatatgacaatcaacatggcttctgtaagccaatgtcaatgtaaaaaggggataggagactgctcttttttttttttttttgtttgtttgtttgtttgtttgtttgagacagagtctcactctgtcgcccaggctggagtgcagtggcaagatctctgctcactgcaaggtccacctcccgggttcacgccattctcctgcctcagcctcccgagtagctgggactacaggcgcccgccaccacgcctggctaattttttgtatttttagtagagatggggttccactgtgttagccaggatggtctccatctcctgacctcgtgaactgcccgcctcggcctcccaaagtgctgggattaggcgtgagccaccgcgcccggctgaggagactgctttttaaaaaatgtaaccaaatgtaatgtgtggatttgtttggatcttgagtcaaactaagtcatttttcagccaaggaaatttgattatggattgaatactaagaaagtatgatttaataagtgatattatggtaaatttccatatttcttaagagacattgaagttaaaggagtgaaatgatataatgcttggatttgatttaaagtaacttcatcaaggaaaaacaagaaggctgagtgctgtggctcacgcctgtaatcccaacaccttgggacgctgaggcgggcggatcacctgaggtcgggagttcaagaccagcctgaccaacatggagaaacccccatctctactaaaaatacaaaattagctgggtatggtggcacatgcccataatcccagctactcgagaggctgaggcaggggaatcgcttgaatccaggaggcggaggttgcagtgagccaagattgcaccattgcactccagcctgggcaacaagagcgaaactctgtctcaaaaaaaaaaaaaaaaaaaagaaaaaagaaaaacaacaaaaagagaaagtaaatgtggcaaatttgataactgttgcatctggtcatggagattctttgtatagttctacttttacgctgcttaaaaatgtttgataaaaccaacatggcatatgtatacctatgtaacaaacctgcacattgcgcacatgtactgtagaacttaaagtataaaaaaaaaatttgataaaatggttgggtgcagtggctcacgcctgtaatcccagcactttgggaggccaaggcaggtggattgcttgaggtcaagagttcaagaccagcctgacccacatggtgaaaccccgtctctactaaaaatacaaaaattagctaagtgtggtggcaggcacctgtgatcccagctacttgggaggctgaggcaggagaattgcttgaacccagaaggcagaggttgcagtgagccgagatagtgccattgcactccagcctgggagacgagtgactctttctcaaaaaaaaaaaaattcaataacacacatatatacccaatagataactcttcattttaagctaaccagtggttggactcacagtctggccccaacttacctttgcagtttgatcactcaacaataagactcagttctagcctcactatactatgtgacacttttacattggccactcactttaaggcctattctttgtgttcaagctgtttcttctttttttttcttccctaactgggcaattacttatctttcaaggactaggttagatgtgacttgtaagttttcaccaatcttttgttcatactactactgggttacctcatactgtagatactatcttcttatgccatggtaagcgttccttaagggaatatagcacaaaagttaagggcacagtttctagatccagactgcctgaggtcacatcctggtttagctactgactagctgtgttacctagggcaagtaacttcatctctctgtctgccttgggtaagtaacttaacctttctgtgtctgagctgtgttgccttgggcaagcaacttaacctttctatgcttccattatctcatctgtaaaatcgcatttacttcatagagttgtattattatttttatttttagagatggagcctcgctttgttgcccaggctggagtgcaatggtgccatctcagctcactgcaatctccatctcctgggttcaagcgattcttctgcctcagcctctggagtagctgggattacaggcatgcgccaccacgcccagctaatttttgtatttagtgtagagacagggtttcatcatgttggccaggctggtcttgaactcttgacctgaggtgatctgcctgcctcggcctcccaaatgagccactgcgcccagccttcatagagttgtattaatcttcctaaatgggtaagaaagggttcagaacagtttctgacacacagttaaatattcaacaaatgctaatttataaggttaggactctctttttgagacagggtctcactctgtcacccaggctggagtgcagcggcacaatcatggcttactgcagcctctacctcctggactcaagcaatcctctggcttcagcctcctgagtagctggaacaacagatgagcacaaccatgcccagctaatttttattttttgtagagaccggattgccatgttgcccaggctggtctcaaacctctgggctcaaacaatcctcctgccttagcctcccaaaatgctgagattacaggaatgagtcactgcactcagcccaggactatttgttttcatattcctcctcacacccagtttagtgtctggcatgtagatgctcagtgaatgattgatttgggtagttttggttctttatacgggtcttcaggttagtcccaatgtactggcatggagctagttacttgagcaggtcttcacaaaggtctgagtagcaggtgataaaaggggttgtgaagtctggactcctaacttaagtggtggagatgctaaaagagaaacaaaggcagcagagttgctgagggtagggagtatggcatttattaaccctgtgtttcccccgtcactggtcactgctcttgactcgtagaacaacaggtacagaactgcaagggatcatccccagctccgtgatcaccagatccacaagctctgggggagtcacatcatagactagattcaacaaccgtagggatgcgtggttctgccagttagccagcgcaacatgttctccccgcttacattgcagatcatcagggtcatctgcaatggaaggcgtacccattatgttctttcagaaaagaagttctagtttatccgcccctctccctccctctcaagtcttcacaggtagctggaggcttctcttttgcctccttacctagctcattagagacaaaggcatcagtctgcacacgctcacagaacttgtatgtttcacagcaaaccagcactggtacattatgggctcgagccaccagggctaactgtgctgtccctacccgtgacatcacagacccgttggccaagagtgcatgagctcccaatagcaccttggaaacctgtttcacaggagaagaggaagaaaaaaatgtcattgttgtatcaatgcaaaataaggtcccctacttacaggacagcaacattaagacaagtaataaatctcaacacctgtgaaaagaagggaaagaaacaaaaacagacaacaagtaataaatcttttttttttttttctttgagatgaagttctgctcttgttgcccaggctggagtgcaatggcgcgatctcggctcaccacaacctctgcctcctgggttcaagtgattctcctgcctcagcctcccgagtagctgggattacaggcatgcaccaccactcccagctgatttgttgtatttttatatttttagtagagacggggtttctccacgttggtcaggctggtctcgaactcccaacctcaggtgatctgcccgcctcagccacccaaagtgccaggataacaggcgtgagccactgagtccggcaattaataaatcctttttttttttttttttgagatggagtctcgctctgtcgcccaggctggagtgcagtggcatgatctcggctcactgcaagctctgcctcctgggttcacgccattctcctgactcagcctccagattagctgggactacaggcgcccaccaccacgcccggctaattttttgtatttttagtagagacggggtttcactgtgttagccaggatgattgtgaactcctgacctcgtgaactgccctcctcggcctcccaaagtgctggaattacaggcttgagccactgtgcccggcctaataaatcttaatgatggcttttcttctgtgaaaacacctgaccactgacccaccaaatctcccacaggaaaagtaaactttgaagttacttttgtcttgttccctcttcctggttgctagtttaatgtaatgtttttgcaatagctagactgctgtaatatactgtcagtgtttttccaattaaatagaaacagagctatataattattttttttgacacagggtttcattctgtcacccaggctggagtgcagtggtgcaatgacagctcactgtagcctcaacctcctgggctcaagcagtcctctcacctcagcctcctaagtagctggaactacatgcgcatgccaccatgcccgggtgtgtgtgtgtgtgtgtgtgttcaagcagtcctctcacctcagcctcctaagtagctgtgtgtgtgtgtgtgtgtgtgcgtgcgcgcgcgcacgcactcaagcagtcctctcacctcagcctaagtagctggaactacatgcgcatgccaccatgcccggggtgggggtggggtggggtgtgtgtgtgtgtgtgtgtgtgtgtgtgtgtgtgtgtgtgtgtgtacagggtctcattatgttgagcaggctggtcttgaactcctgggctcaagtgatcctcctgccttagtgctgagattgcaggcattgagccatggcaccaagccagggctatataattctaatatttttaaataattgtggctgggcacagtggctcatgcctatgatcccagtactttgggaggccgagacagggggaactgcttgagcccaggagttccagcctgggcaatgtagcgatatcccatctctacaagaaaaataaaaaactagctgggcatggtggcacacaccagtagtcccagctactcagaggcggaggtgg

SEQ ID NO: 985 - DNA, 58139 bp, Homo sapiens
attaaagcctctccggtatctgacacaagtcagaatttccactgttccagctgagcttttatgaggagcagacttgagagaaactgccaagattttctggagtacacagggcacacggccagctgaacacccgcttcccccactcgctgctgctgggaagagagcaatggactccgaataccttccagccgaaagtcgtcctcctcttcctcgctgagcgtgtctctcaacacgtcgcccacgagctcctacaagaagacagagcagaggcattgagcaggggttgggggagcccagtgctgggacgttaaaagcagtgccatgaggaccctgggctgattcttctgattggaattcaggtcaactgaggcagatcctattgcacctgaaaagttaagtgccaaggtgggtccctcctgcccttaacataaacccacacgcatcagcacaacattcaggccaccacaggctatggctccactgggtcttccatcatgcctcccacatttcaccaacacacatgccttccggaaaccagcctgattccttgcacacaccctgcctgttccccaccagtgagttaaggatatctgggatctcatcccaaccaacctgaccaggagatgtcaagttagcgaggggagtgttgctggtccacaggctgggaaatttctaggatgtcaacaaaggccccatctgtctgacccaccctagcaggataactccaaatatggaagaagctagaccataccttgtcaaactgtcttctgtatttattggtattctgccagaagagttctatgatcaaagaagattcttttaaacaaagttaaacaagatctcttacagcaggacttatcaggacttttcctatggttctaaacactgaatctccaagtgctggcatattttgcattctccaaacttatttagaccatggagcttcgtttttcaaaagtatcacatgatacgcgtgtcccaagaaacccactttaggaaatactcctgttatgggaggacagacaagggtttgggggatgatgatgctatggtagcggttctcaaaacacaaaatgacaagcaataaaaaagcccaaactcagcagctgtcaccaacttctctttgtgaaaataaaagagaaaaaaaacaaaaacaaaaacaaaacccaaccctctccttaggggaaaaaaaattctacacctcagatgatgcttaaaaaaaaaccagtcctcttcttgatgaacaaaagaaaaaacacggctttgtattgctgatctcatcaactggacacagctggaggtaagcctcttgcttttttttgttttttgttttaaagacaaacagctaacattttgtggctgttctctttcttctttcaaatctttctagggcattacacactctttcttaaaagctgttaaaatgtggccattcagactccggtgtcccatttacttcaaaaccaggctactttattcctcgagtcaggatggcttcctctcctcctccaccaattattataatcatcgaacatatcctgggcttgtaaactggctgtttgtgttaacagagcccgagttgacaggggagctgggagacgatgacaggaaagggatgcacacaggtggcatcattagatggctgggacgccccagcagccaattgaagcccatctttcatgcagaagagagacgggtgccaccgccccctgaaaggctggtaggcagagcttccccgagggaacaggcaacagtcttcaagagaatctgcgcacctcttcatgctgaggtcttctgcagagcggggctctgcgcctgccaccctgactgcactgcagccgggtgacagcatcaatgagacgtctgagtactcgtgtctttttactggcacacttggaagagtttaaagactccagacatcgccaccaacaaggcagccgtgtgggaccctatgacaatgaccgcatgtgctcaaggcaccccagtcaccacctaatgacagcttcagcactccctgctcggagaaccaagctctctgacacactcagaaagcagagttctggcaagttctggcataggcctctcaccactcaacagtaccctgctctggagaacactggaaagctccccggagccatggttcatggacgcactgtactgtgccaatgctcaactttgcaaaaattcatctccccagccaggcgcagtggctcacgcctgtaatcctagcacttcgggaggccgaggcaggtggatcacgaggtcaggcaacctggccaacataatgaaaccccatctctgctaaaaatacaaaaaattagccaggcgtagtggcaggtgactgtaatcccaactacttggggggctgaggcagaagaatcgcttgaaactgggaggtggaggctgtggtgagctgagattgcgccactgcactccagcccaggtgacagtgtgagactctgtctcaaaaaaaaaaaaaaaaattcatctcccccactgagccacacggcccagggtctgtggcgtgcagcgtgcatgttcctagagctttgagtctctaggccagaagccacgcgggatgttgagccaaacacagaatcacatgctggctgtaccgcctgcctcgcctttggacctcagcctacttatttgtaaaatgggcacagtcatcaaccataataataatcaaacagctgacacttactgtgcattttccatgtgtcaggcacgatgctaggcactttatagtcattcctcagtacctgtgggcgactggttccaaaactccctgaggctatcaaaatctgtagatgctcaagtcccttatataaatggtgtagtatttgcatataaactacaaacatcctgccctatactttaaatcacctctagattacttacaatacctaacacagtgtaaatgctatggagatggttgttaaactgtattgcttagggaataaggacaagaaaagtctgtatgtgttcagtacggatgcttttttgtttccaaatattttctatctatggttggctgaatcaacaaatacatagcccatggataaggagggccaactgtgtaagcgtgtatttattagccccctgaatcatcacaacagccctggtctttccatctttcaagaaatagatgcttattaaaatgatttgcaaattgtaaagcgagaggtataatcattactgttattttctacaaagaaagtggcctcaaccctgaagtactgtatgagaccagaaacagttctaatgacagtcacccgtcatctaccaagtgctcacagtgtacgaggtgctgaccaatgggatcttcacgggagactctggagaatggcctccccacagccctgcatctaagtggctaggaggctccaagaggctgtgagaccccctttggatcacctgccagcaaggggcggagcggggacttgagccagctccttcagatgcctcagcccgggctcctactcatgcaaccagggctcctgtgggcatgggagcagaggtggtcaggagtcctggcacctaccagggaccaaggatcacacctaaaggagtgcaagaaaaatagcccagctggcagctctagtgggctcgggaacattctcacattccatcctaatgcctggcgagccagtgcctcaatgtccaccctgggacgatgctcacatgtgtgtccaggaggcacattcgaatccagtgatgtttagggcaatgcacttcctgttaacctgcagtcaggaacaccctggatgccctcaaaggcatgtgggctggatctctgcagaggagtgccacacgagagggacgccaacagaacaagacagacctgcagatctcccgggcagagggccagaccacaggacaggcaaaggagccctcacaggaagacacgcagactgtgctgctacctgtacacagaggagagcaccaaacccatgtatgccatgagattgtccccgtgtgggtgaacatgcggaagacgacagccacggtgacttccagagaggggagggcagacagaggcagagggtgtggggggggtcataaaccccagccttatcagaagtgttctcatgtttaactgatgagtatattacttgggtaattaaaacccaatttagtaaaactgcagataataacccactttacaaaagaaaacaaaagctgggagattaagtaacaagtccaaggtttcatggaaagcaacagagtcaggtagccccctccaggcctcggccccctcgtctctagaatagggaggccagacaagatgatgctcacagttccctggagcacagaccttctggggttccagcccgcatcccatcaatgggcagatctcttctctagggctatacccaggaaacaagaggaagaccggggctgtccattttctgggcctcaagttctatgtctctcacatatacctctcccctgcggacctgttatctctgcccacacagcctccctctcattcccaggcccccagggctttcctgggcctccagagcccactctgcctacaagctcggcaggctgaaagtgctaggaaattacccagcccatcccaacactatacaacatgcaggccagtgatacaaaaataatcctcatcaaagggcagagagatggaaagagggcatggcaggcagccttttgagagggctcctggaggcctggacccagggatgggagaggctgggggcatcctcctccccaggagaggaaaacagacccgcccctccttgcctgggtcatcagaacccaggcctcaacatgctgcttccaaagataaatggcatctctttccaaaggagccaaaatatagggcagagtcctcagccactcccctgaagacccctgagcccaccacagccacaggtcacctggtggtggctcctggctctgcccaccaggcctgtcccctggatgcagccaagccaattggaaccctctcctgggacccctccctcgggagctgacggggacgagctcttctctggtgccaaggctgcatctcatctcatcggcagcttctcagagacagctcactcaaggaggcagctcacacagagacagaggccagtactgggaccagcctcaggcccagccttctccagaaggaggctgcctgtgggcaggactctgggtctgttttgccctcaaacagcgcctggtaccacgcaggcactcgaaaaagtgtctgttcggtgaaccctggggcaggcccaccctaacccgcccttcctaccgatgggacggtcacagaagccactaaacggcctttgctgcttccagcaattcaggttgggtttccgttacttgcaactaaaagctctgactcccacagctcccagaagcaatccacagcctcctcaaagctaaatccaggattcccaggcaagcttgggagccagtggagcgagctcctgctgccctgctgtatcgcgggcccctgcaggagcttcacccgcagactccactcagagctgcggaggctgaggcgagagggaagacaggctcctggggctgcacacacagaccaggccttttgtatttggcctgcaaggaccaggccttcaagacgccaaagacattgagcagcaattaaaattcctcagatttctcctggactatttttatctgcccaagatgcaatcgacatgctcctaactgtagatccccggccttcagctccccacatcctggggaccccagcctgagcctgcttcctgggcttgagagtttgcacagggaaggtggacagccagcaaggagtgggacggcagggctggcaggaaggacttcagaccctgggcctgactctgaaaccaccatactcccttcctccagccctcaggcctgagacccgacagggtactcataatccctagagacgggttgcccaatcctgaacctcagccagcctcagtcaccaaagggccagcaaaggccacttcctgggctgtcacaccagcaagtcgcaggcatccacatgccatggtcgcgccttcctccagagccatgtctctgggctaccatgagtacttaaatgcttctctttaaattggctctctctctctttttaacctagtcttgccataaagcaataagatcaataaaatcacaggtgttgggggccttggtttggtttggtttggttcttagatgggggtctcactctgtcccccaggatggagtgcagtcgcatgatcacagctcactgcagcctccaactcctgggctcaagtgactctcctgagtatctgcgactcccaccgacacaggccaccgtacccagctaattttttaaaactttttgtagagacacagtctcgctatgttgtccaggttaggtgttttttgttgtttgtttgtttgtttgttttgttttgtttttttaaggacaattcatattgaacaaattcagaatcattaaaatataagacacccaccacttgcccctccaacccctcaataggacatcaaccattgaaccatgctttcggaaagacaggatttaaagaacctaccccctggcccccacagtggtcaggctggttccaataagtaggaagacggtgggtgggggagagacaccagacaaggtgggcaccaggagatgccaccaaccttcccacctggccaccctccttgaagactcatggcttcagtgtgatttctgagcatggagaaaaaatgactaatgggggaaaaaaaacccaaaacaccaacaccaacaacagaaaagagtaaatcttgacatcacccagaatgctccctgatctcaaactgctggcatttcagagcccttaagagatgaaccaatgtagggccaattgcccagagccaggcagggcacggggtggggagactttgctgtttgtctgaccacaattttccgactagacagtgttcaaaggcatttctacagtggaaactgggatctgatgggcatgttggggcctgggggtaactgaggtcatgaatataaaggactcagtgatgatgataaccagtcttagtcagtgtgcgacatctgccaagtgttccatgaagcacgttaggggcatcaccgaccaagtgctcccagcagccctagaagctgggctctgcgatgacccccactttggccatgaggaaactgaggcttagagaggttaagtgactcactcgagttgtcagtcaggtctgggtttgagccttggttcttctgcttttatactgtgtgactttgtacaaatgagtctacctgactatgcctcagtttccccagctgaaagtggaaatgacagcccccacctggcagggcagttgtgagaggaatggagagtatgtgtacagtgcttggtgagtggcctggctcaaatagcgtgtcccaagtcacagctgtcacctccttctccctccgggccctggtctttcattctcttccctcacatgctctcttctgccctggtttttgtcagggatgccacagcggatcaaagcccagcccagcactgcctcatcaccccagaaggcctcaggcgaccccacttctggccggctgcagagagcagagagagtgcactcagcgcttgtcggagtctctgccctcccacccactgctgaccacacacacacggccttcccacccaccactgacctctctaagccactgcccaccacaccactgaccccaccacaccactgatcctgccccaccactgcccaccacaccactgaccccaccacaccactgatcctgccccaccactgcccgccacaccactgaacattgcaccactgactctaccatgccactgcacatcgcaccactgatcctgccacaccactgcccaccacaccactggccccaccatgccaccacctgccacactgctgactagcccagccactggcccgccacgccacacagccgagtgctgataagaggagaggcccgagggcctgtggcgtgcctctgatcaccaagcagctggggcggcatctgccagcagttcctggccctgggacaggcccccggtctgctgccagggtctagcacgtgtgacctgccgacagggtggccctgagccaggctgcttatgacaggcagcactgtcatctggccccaaggaagggtgccccatagccataggccacctcactgtggggaaaggatgtgtgctcctgcccagggaaggggcttggggacccaagaagcctggaatttcttgctcagcctcaggaatgaagggcttgagcttcttgcttttctgaacctaaacgaaacagatgaagtaagagcctcttgattcctataccctgaggcctcattttacggacaggacaagagtgtccatgagcacaggtgtgcgcgcacacacacacacacacacacacacacacacacagagtccacccatgcggccctgcagtgccctggagaaaccatcttgcagaagccatgctcctacccactctgatcccatcagccctgggcctcccactctcatctcctggccccttctgtccccttgtccccaaaatagctctaagaaacttgtcaccatccctctcacaggccagaccgcccacttggagcctcccagccctggaccatcctgtccccttcacccggagcgccctcctccctctactgccagtgaagtcttttgcctcctccggagccactgtggatttcgacttcccaccatccccaaccaccagatgaggacataatcaagagggtcacactggcggcttccagaggactcggttcattctgaaactcagcagttcgcatgctgccagggctgtgatcgaaagcctcagtggccacatctataaaatgagggcaccaatcccacccgcctgccacgcagcagtgcacgatgatcacaccaaaggtgggtgtggaaaagccgagaaggtgagaggggccatttgggaatgagggcccagggtccacagtgctgtcagataggaagctgctgaggagcagcctagtccgctcctgtgctgttgataaacaaaaaggtgcgttttccagaatgtttctggaaggccacgctccacttcagaaatgggaactggggcgctgtctccttcagctgtctgattttctgggtgatttgaattttatatttatattctctctttttaaaccaagaacattcaacccttttatactgaaaaaaataataataactttttccaaagcggtttttccattaaaacaaatgatgtggctctccctcctgtttgatgtcaccaagttgctcaacaggcacctcaaacttcatgtgtccaaaccggacgcctggcggcccccaaacctgtcctccccagtgccttccctgtgtacacagggcagctccctgcttccttcactctggccagacaccccagaggcttccgcacatcctgttggctctccctcaaaacacaccctgaaaccaatcattgccacctcctccacttctgccacgcattccaggccacagtcctcttgaataatgacaaccattttctattctctgccctcgtcgccaccccaacccctacccaattccccaaagtcccaccaaagcccatcaaagccccacccaatttgtctgccctatcacctccctcaccccttctgttcctccccattcacccgctcgcccacagccacacaggcgtccttgctgtttctccaacaggttcagctcattccccattcagggtcttcacacacgctgttccctctacccggaagactcttcctctggataacccctccctcctgcccctccttcaggtttgggttcattatcaccttgtcacctaggtgaggtcttcccaaatctctttatttaaaactgcagccccctctcccacaatcccttatttatctctggggcattcccaccatctgacacattatgtatcaacgcctgacggcggaggcactcgaccagcgtgtgttgaaccaccaaatgcagctctgtatttactgactcagaaaaacacgccctgcattttcttgaaagaaaaaagtagttgccaaacagcagagaaaatgtgattacatttcctaacattatctgcacgtgtttccacgcgctgtagtaggaggcacacgtctgcagagacgggcaccaaaatgctcccagaaatggtgcccggtgctggattccaggtcacccaatggtcttccatgaacacacatgattacttctacaatcagaaattacagcaaagtgttttgaaggaaaaaaaaaatgctaaaacatacaaaaatgggcacccaagttggttctagaaagactcacactcagaagtctgctaaaagggtcttggccctagcagtggcaagacctacagcattctggtgaaatgggtggcctcctgattccagctgggagggaaggtggagactccagactttggtccacccagaccccattgctcccttccacagccacacagtgcacccaggccacaaagaggccacagccacacccatgcctgcttctcactgctctcactgtacatgcataggaagccaggggctgtgtaatgcagacagcgctttgattccagaaatggcatgagaccagctgagcatgcaagccaggctgtcatcgggggctcagggggagcagggtggcactctctcctgcccatcccaaccagcacacaccaaattttgctgttgccattctcaggcaaccaaagatctcaaagcaaaaagtatggggatctagaaggccactgcctgcccctgcaggtccagtcaacagcccacatcaggggcccgtgtcaccacagggtggtcacctgggaagccagtgaggtctgggagagtccgtatggtcagcatggaaggtttgaggccactcttgggcctggggataagaaggtcttcatggcagtgactccacccatcacacctgtacctcacccatcacacttgtacctcacccaacaaccccaggaggtccacgtgtgagctattgctgtttttacagatggggagacttagagtcataggggaggcaagagagtggtaaggctgggagaaacggagcactcccgagaggaaggccagggctctcaggacatgcccctgggtgttcctggatctggaagagaggcctctgctgtctgagccccacatttccaccaggaccaccagcatcaggccaggccagagcctttgttcagaggttctgacctgcaagaaggacccagcccctctgagaatgtccccctagaaaaatgccatgcaaagaaaattgcacattgaatttcagggggttcatgaacctccccactacaagtccttttgtgaattttagtttaggaacctctgagagtccagatggggaaactaagggctcaaaaagggacaggacttacccagggtcacaaagccaaagaggagcagagccaggatccgaatatagaggacccacagctggtagcaaagaaccagcgagcgatgagttccctcggggagcagaggcacaggacaagagcccccacacaccctgactgccaagggctggagcacccagaccaacaagcccacctttggacggtttctccacaagcactgtctcaggcaaccaaacatttcaaaggaaaacgtagtgggtccaggcatgggggcccaggacgtttggggaatgctgcgtggacttctcaagcctttccagaccacctgtagcaggcctcccacgaggtgctcacagatcaggggtctccttacttctttagaccctttgatagcagtccacctccccagggcaccgtgtgcacgtgcagatccccccgggtctgtgtgcccccctcccttccctatgtgctccccaccagcagctcacacctgggggccctcttcagaggcctgccctagggctatgtctgcagactcagagaactgccgtgtccccaccccaggtggccctgagcctggtgcaggagaatgaaagcccatacctcctgtcacgacaaactcagaagcataatttataccccagagctcccccagagggtcagactgaagccaagactttgcctgaaatggcacctgtgcttggcttcttcctcttgtctgtcctgcttcctccactgcctcactggcctgccctgccctgggacagtgtcctgagtgaatcactagcacgtgaccctcacctcaggctctgtttctgcagtccctgacctcacagggctctcccctgaactacgcgggtagttggaggaatcctgacccacttggtgaattcacagggagtaggcaggccaatgaattgcaagctggttggtctcagacaaagcaggtggaacatcagtccagcccagaaaggcaatggtcacactgtggccaatccagctacgtgagaggccagggaccctgatgccagggctcaggcctgagaggcagaaaaatggaaatggacattttcttcccaccccaccccaccccatgccagccccacttcaggaaaccccctccccatctttcagagcctaattcaagtgcaagaagcttgttctaagcaccttgtgccccaggaacctctctcattcagccagcgcgtttcaggctggcttcacagactgtaagtttgggaggaagccgaggctgtaggaagctctttgtccctcatctggctcctgcagtgggcatctgaaattcagaagcccctggtctccagcgcccccttcctccttcttctgggaacactttgattttccctggcggctttctagacctcacaaataaaaacataggacattcagttaagtttgaatatcagataacagatcactgtgtagcataagtatgtcccatgtagtatttgggatagacttaaaacacaaaaaaatgaagtgctatttatctgaaattcaaatttaactgtgtgtcctatattttatctggaaaccctgcccctccattcctctcacccacatggtgtgggcaggctgatttctccccgtaaccaccagggagggcacatgacccaggcctgcccagtaagagcttcgcaccacgccagccatggggactggtcagggccgggcacacaacccaagctatgccaaggagaggcaaccccaggacatcttctttctctctgttgactttggtgagatgtgagctgagagcctgaccctactgagagcactttaccacctcacagagaaattctagctatgaaaaaagctaatacccaggaaaacagagccacgaggggatgcaaaaggggtcctgacatcatttgagcccctggatcaaatggtgcctgaagctagtacctcccctacatttttcaatgacgtggaccacaaaatctccccttttggcttaagccagggtgagcttattctcctcataagccagtgagtgagtcctgctcactcgctcctcctcacccttgccacctgggcatgaggctgggcagagtctatgctcagagaacatgtttaatttcactaaggaggatggtgtggggcgatgggagagcctgagctctccagtcaagcaggcacagttcccggccccactcggttccatcctcgttccaagtccttgcacaacaaactctccatgagccttggtttccctatttgtgagataaacataggtacttatacctggactgcccatataatgctagtgccttaaccaggacactttagagagacaaagggagtgctgttcatacccaggttgggagagactggaactgccctgggtaaagggaccagggatgccgtccctacaactgaccctgcctgtctccacccgcttctgcactagccctcccccacagcccatgccttcaattccgccccctccccctccccatcaccaccctctgtgcaggatgctcccctactcgctgcttctcgctgcctcctaattcattcttccagtctcagagaagccatccctggagccccgggctctgtgcgggccccactctgcatcctccttgcagcctttggcgctctgtgagacaactacttgtggcttgcaggctccccagccggctaaactcgttgaggacagggtccgtacatttctccctcattactgaaggcccttacagagctggcatggtgcctggaaaacgacacataaaatagcagacaaaaaaggacaccgctaaccctctcttcctcctctctgcaggctctgtattttctctgtgcatcgataaaaccatcctggctgcgatgccaggcagggacaagtgaaactatgaatcatggagtggggagggcatggggcagggctaggacccacccccagtgggcccaggacatgctggcaatgttctcagagccagtgacttggggacagtggccttagaaggccccgcccagtccagcagcccccaggcggcggcagcagcaacgcgctggccttgggacagctttcattgatccaaggccaatgtggactggacctgagccggctgcctattccagcatccagccctggcccctgctcaaaacacaggcctggcgtctccctgtggccttagccagctctgtcctcagcggcagccaagtcactgcccagaatgcaaatggggcaggtgcaatgggcttctccaatctgagaccaaggccatcacatcccacacacagcccaggttgttccacacacaagcagacagggtccccttgggttgcttggcccccgcccacacagctttcctgcctatccccgggcagccaccccacctatttcttggttcagccaggcatatagcctgaggtcaattacctggagaacgcattgccacaccagctccctggctcgcaccccagcccaggtggcgcacgctcattttattttcacagggccccttcctggctccacagccttcactggctccgtgcttcaatcaactcaaaaccctctgaagtcttgctgtagcttctcagtccagctcactgggaaacaaatggttatggtagggaaaaatgctagcctgggagctgggtggtctgcctcagtttcctcatctgtacaaaaagaggaagcatggcaagagggtatctccaaagactttactgctacaatagagcatgactccacaggctcaggagagggccaattcagccaggccccaggctccgttcctcctctgctgtcttcaggccacccagaagggccactgcccacttgcaaagccaatgatccgtcctcagtaccgtctgtctcaggaggcaaaagtattttgaggagaaggaaagaaaagtgtggatgtgaatgcttccctcaactctgcatcaacccagcacccaaccctcccagcgccagacaccctgcccacaggggagccacagtggctacagatggagagagaagcgcagctcacaggctgaggaacaaacggcaaatatctacctgcatggaacaccaggaaggaccccatcagcctcagcctaacagtcagtacctcaaaaaagaattatcaggttaatttaaaaagaggcttcattctggccgggcacagtgactcacacctgtaataccagcactttgggaggctgaggcaggcagatgacttgaggtcaggagttcgagaccagcctggccaacaaggttaaactccgtctctactgaaaaaaaaaaatagctgggcatggtggcaggcacctgtaatcccagctaccagctactcaggaagctgaggcagaagaatcacttgaaccttggaggtggaggttgcagtgagccgagattgtgccactgcactccagcctgggcaacaaagtgagactccatctcaacaacaacaacaacaaaaaaaaggcttaatgctaatggccacaaactcataatggcagtaaaggagcaaacggcattgccaggtggtgtggggcccagaccatgcccccacatggcctgaggcttgggtcctggctctgtcacctacaggttgtgtgatgctgggcaaactaataaacttctttgtaccttagtttcctcctctgtatgatgggcaaataataatatctgccttgtggagttgctgggagcattaaattagctcacatttgtaaagcgcttggaaaacaatacctagttccttagaagcaccatataaatgcttgttaaataaataaaaatgaaggtgaatataaagtacataaagacacacttgtaatgtaaaagaaggatgaccatctcaagaaaaagaaggatgactgtttctaaacatctttagcattcgttggttttaacatataggagggtgtgaacacatgtggggatttttttcttcctccatcaggcataggccagacttacatgaggatctgatgtgttctaatattatttgaacaaacacaaaagtatcagtatggggagatgaggttaagcccaagagttctggaaaaggttgggcctcctccaaaaatgggaaagctggattggcaggagaggtcacctatagtatcaaggtcaaaagagtgttcagggccaggcacagtggctcattcctgtaatcccagcactttgggaggccaaggcaggaggatcacttgagcccaggggttcaagaccagcctgggaatcatagcaagacctgtctacaaaaaatttaaaaattagcctggcatggtggcatgcaactgtagtcccagctactcaggaggctgaggcaggaggattgcttgagctcaggaatgggaggctgccgtcagctgggatggtgccattgcactccagcctgaacaacagagcaagaccctgtctcaaaaagagaaaaggaaaaaaaagagaagagaaaagagaggagaggagaggagaggagaggagaggagaggagaggagaggagaggagaggagaggagaggagagaagagaagagaagagaagagaagagaagagaagagaagagaagagaagagaagagaagagaagagaaaagaaaagaaagcattcagcaaaggcctccaacatgatccatttgcccgctgcctttataggggagcgtgaactacccagacttgggccaccacctctggagggatgaaccctcggggcggctccactaattacaggttggaactagcaaggcacagccctgtcttaatggtgcccccgaccaggctgactagagtgggctgcaagtgccagctgcccagagcttccaccgtgcagcacctcagggcatgctgggctatagaaaagcaaaaccaaacaaaacccatgaggaaggcgtgggcttaaaaagctctttttcaccaccagtgaagtttaatgcttaaaaaggaagtcaagaaactcgactggtgcttgcgtctgagggactggcgcgaggaaactcatttccgtattctctctactttcgtgtctgtctgaaatgttctatgagaaatagtattaaaaaggggaacttagtctaaagaacaggggcttgagtttaaaccatcttgggagaagcagccaggcccaaggctcaccaagagtcaccgcgcaacgaggaagatctgagtgctggggtcggagaggacattaggtttcctttaggcacagtgaggtcacagcaaaataggaagaccaaatggtgtgccgcactgaccatgtgccagatgccctcccaagcgccccatgtttataactcatttaatcgtcacaacaaccatgaggcagacgttgctacttccccattctacaaacaaggaaactgaggcagacagtagttaagaaatatgaggccaggcatggtggctcacgcctgtaatcccagcactttgggaggctgaggcaggtggatcccttgacgtcaggagtttgagaccagcctggccaacatggtgaaaccccatctctaccaaaaatacaaaaattagccgggcatgatggcgggcgctggtaatcccagctaatcgggaagctgaggtggaagaactctcttgaacccaggaggtggaggttgcagtgaaccgagatcacaccactgctctccaacctgggcaacagagcaagactctgtcaaaaaaaaaaaaaaaaaaaaaaaagcagaagaaaagaaaagaaaagaaacttgaacaagtagctaacaagtggcagcactgggatttcaacccagcctacctgggcatgaggctgagctctagccaccctgctgagctgctgcttcatttcagccaagaacagatctcagcccagtggggtcagatgcagaaacaatggcaaaacaatggattaaagctatagcctcaacagcatagctttggcatgggcttatttgcaagggcagacaagctgataactaccgttacctgctgttagggtatgtgacctgtcattctaaacttgcagtctcagtcccagttatttaagttaacttgaaatcagcatttaaatctttaagaaatactggttcctctattagatatgtaagttgaatgaactgagcaataaacaaaatactgaagggtgtaagttttcctttccatgtatgaatgtggcctggacattaaggaatcccatcagtaccaggccaccagccattcccgtttcatttgctgtccacccaaatcagccacacctgccctgaggacatctgcactagggcagtgatccccaacctttttggcaccagggaccggttttatggaagacaatttttccatggatgggggcaaagggagaggggtcggcagacggtttcgggatgaaactgttccacctcagatcatgaggcatttgatagatttccataaggagcacacaacctggatcccttgtatgcacagttcacgatagggtttgcacttctgtgagaatctaataccactgctgattttgacaggaggcagagctcagacgctcacctcctgtagtgctgcccagttcctaataggccacagacctgtacccacccttggcccagggtttggggatccctgctctagggaactctttgggattccatttactgattcaactctggacttaggtccatgatacatcccagctgtagaagcagagggaagtccagaggtaaagcatctctccttagtgacccacaccttctttcagatccatcaagatatatgcaaactgcagagcaatttttccatgtcagacatagaagccagagaacaaaagttacgtggaaagcctagataatgcttttccccccaaagtaatacaatgttgggctatgttaatagaagtattacacctatattttgggaggtgacgattctactattttctactaggttaggtgccacctgcaaacaaaatctcatatataaagaaagacatagctacaccagccttgcgattcaaagtgtggactaagggctagcagtcttgacatagtctaggaagtggtcagaaatgcagagtctcaggccccatctaccctacaaaatcagaatctgcatttttgcatcatccccacacaattcatatacacattcaagtttgagagaccctggtatagggatgaccagaaagatgactgcatgattacagctaatattgatatacctagcacgtaccaagccctattttaatacatgtgagtactttatatccacacagctttcgagtcgtggagctgatggcataatggtgaaggggtaggacctcaaggaacagtgagaactcacgacgacctgagagatgggatggaagaagccagcttcctgccttcagacagggagagaatgactccctcaccagaggaagaaggacaattctccatatttcttgaaggcagagcaggactaatgacacataaggcccaaattctctatcattccaggagctagagttgtccaacaaaggacaatcaagggagtgagcttcctgtcacaggaggtatccaagcagatgctgggaggccttctgtacaggatgcacagaagaggattcccatttcacaaaggagtcagtcttgatgggttgaacttttctctctaattgcaaggccaggaaggcatcttctatatctactgggaaccagaaggtgggtgtgctcccattccccaccaaaagctgcctgtgggttgctatggcctatgacatactaggaaacctctgtggtctcaaaagtcggaacagaagatggggcctattattaacccttcagccccagcacctccctcaacctagactgcagacacgtggctcacggtggtcctcaggtaataagcagagctaaatgacccctggctggagatgggaggggaggtagggagacagccacccaccccccgcccaaacaaggagacgcctctgtgactcagtgatccacgctttctcaaacagggaaactctttgaagaagtcccccatccactcaccagtgggccaccaccttgactaaccagatcccacgtgctggtatctacaagtgactgcaagttttgctctgttcacagaagaacgaggtgaaaatgaaaaaactttgttgggaatttgccttctaaaatgtcaaaggccagggaaatggacctggcatggaggcagcagggctgagggtcagagtctgaccaccggggtcaaactttcagctccaccctgggtggagggtgaatctaagacctccctgagccttatattcttgtctggaacatgaagatgagaagaatccctgcctcgtgaaaccttagagcaatgcctagcatgctgtaagcaccacatccaaggaacaccaacagtggacaggaacagaacccttgtgaagagggtgctttactgagtatgtccgttaaacagggcacagactcgatgaaatgacaaacacacagtgatcagcacgtctgtgacacccaggggtcacttgttcaatgctagctgttatcacggtccttcccactgctatcagttattactattaccaaactcccaatggaaacaagaccacagtgtcacagagcacagtgtccagcccaggaggaggaggtacagagaggaggaatgcaagactctgagggctggggcgggaatgacttggggcgtggggaaggccctgcctgggtaaacgcttggcggctggatcttggaggcagcaaggcctctggagagccagctccacggcctcagaagtcaggccagctttcagttcccggcatccgggccccacgtcccccatcgggcctgctgcccagggcactcagattcttccaaggcccaggatgcacgtccaaagcagcctctcagactcaggccccgaattccttggccggcagggttcacgtctccatgcggctgacagagcccagctgccgggcgccttctcctctgctcccaccaaggccctaccagcccctgagcccaggaattgggaagtgccagcatccccagctcctgccccagccacgtaatcagtacaagcacccatgagggactttagctatcccccttggttcctctgcacctggacagtggcaggtactacatgttcaaaatcggaatctaatgacaggtttccccatccacctcctttgtgaccttctccagggactggaaggaaatcccatgaaagaacaagttttacagaaaaattaacaaaaaagaatcctctctgttctccaaagcagcataccccaaatctggcagcactcggactcctgaggacagcaagggaaaatgccatgcctgggctcggcagcaggtgccttcaatcgggggtccgtgcagccaggcccacatctcggacctcagtctgggcgcctgggcctcattacgatctacagacgacagcccagagccctcagatacacaggtgctatagggtaagtgtaggggtgtcaagaagctgctgtccacactcataaagggctcagcaggtgacatcctaaatgaaagagacccttgtttatccatggaggtcaagggaaagaaaccaaacagccccagtagctctcaattctccatgtgcctatggccttgggttgcttataagctggctggtattttaataattgctaacatttaccaacggctactctgtgccagacactgtgccacatgctttacatttatccccttttcaaacccttgcaacatcccttctattatcatacccattttacagatgagaaaactgaggcacaggttaaataatgccccaaagttacacatttggaaagcagcaaaggtaggaccttgcccaattctaggacctatgggctgggaaaagacccttcaaccaaactggggcaggctgattacattcatgtactaatttgttcatgcctaactgattccatacccttttgggggagccctcccacactgagactgggcttagccacgtgacttgctctagcagacgggacggtagtgaatgtgatacagaaacttgataaggcactggggagtccacttcctctctcagaccctgtccctgcaataagaaacgcctggcctgctggagggataggacatacacaacaaggagaggccactggtcccagccaattctgatctagaccaggaagctgtggccaactgtcttgaagcatgagcaagcccagcccagatcaacccagcccaggtccatacagctcccacctactcgcagatgtgggaggaataactaagtcttagggtggtttgcaacatggcaacagctaactgatatgccaactgcactgcctgttctcttttgacacaagaaaataactgcctgagaattaagagaatgagtgagaaagacatttaaatcaaagggtttgctttaaatgagggattgtcaaaaagttactgtgtttagatcaggattcaaattttagaattcttgacaatacccatgaagggatcaagccacatcaggagtcacaactctactcgctccatcacacctgtgtcatgtcctttaaatggaaccctttattgatctgttctcctcttttatatacttaaaaggcaatgctctaccatgtgccaggggacacggcatctttcttccatgccagcctgacatgaagctacacctctgtgtcagctatccatcattgtgtaaaaaaaaccgctcctgaacttagtgacttaaaaccatcattttactatctttcctgatgctttgggcagactggcctcagctgggcagttgtgctggtagctcctgagtcttgtgtggttgcagggggaggaaggctggggctgctgtcatcaggagtttgtctggtctggaataccccaaatggctcatgtctgacgccttggtaggggtggctggaaggctgggctcagctgggacactaattgggacattgggagaactgggcctctctcttgtcctgttcggtctcagagcctcactctccacgtgacctctccaagtagtttctccagcaaggtagctggacctctcatagggcagcttggggctctcaaaagcacaaaagcaaaagctgccaggctttcttacacatccctcccactgcctctgttggttaaagcagttacaggggccacctagattccaagtggggagtaaactctacctctcagtgggagggcaacaagttgcagccactttaagccaccaaacctctcacctcctacacgcggccccctctgcctaacacccaagtcggtagcagcacacatcctgaaatggagcaataatgcatttttttttcccgggatggagtctcgcgctgtcgccaggctggagtgcaggggcgcaatctcggctcactgcaacctctgcctccagggttcaagcaattctcctgcctcagcctcccaagtagctgggattataggtgcccaccaccacatctggctaagttttgtatttttagtagagtcagggtttcaccatgttggccaggctagtctcgaactcctgacctcgtgatccacccacctcggcctcccaaagtgctaggattacaggcgtgcgccactgcgcctggccacaataatgcatttttaccccaatgcacactgggcagcaggcctgggatgggtctgcagcatatgcattgagtaaacaaatggtgtattcccagcagaaccacagataattcgtggatgaacatcaagacaaaggtagcagccttggaaccccagaatccctgctgtgtcacgagagtgccccaaggtgccattccagaatgaatgaatgtgtgggatgaccactgaatggcaatgttcctctccctgcacatacacagggatgtctggaaggtatgaggcaaccacattctttgcaaatacctcagtctaaaaatgggcacctgcaagatccagactcccctgggagggtccactttaggatatgtgggagggggcagctctctctcagggcattttgaatctcattttggctggggctctaggcacagacctgagggactgctgtagggaggacagccctgcgagagtccttaatcatctaactaaaaccacgttcaaggcataattagcaaacagctccagattcatgatctgaggcccactgactctaatggactaattaggtgagacatccttgggcgggcaatgcactctggccttctcagaaacatcccagagagctcagcagatcaaggctggcatctggtccatgagctgccttacgatggctgggcaaagagacaaacgcattactgggcaagaactacacacagcttccagagatcaacaaggcaatcccttccaccccagcagccccaaacaaccaatccttgcaacactcagatcctggacacaaaatcctttgctctgagcaatcagcaacatgctctctgcctcctgaaccaccctgccctttccaaatcaaggctaacagcaataaagggcacgcatgcctacacacacaattctgccctccccaggtcccactcctctgtaagctaacagccactgagagctgctacaagacagcacctcatcatcctggatcagaaaaataaatcaccagctctgtggaagccccaaaagtactcagggcctcaaatccaccacagatagcagacacttgctgtttagccagttctctccatccgaggtgcctctgagtaagtggcaggggtcccacaaagcaataggagctggcagaaggcaaagccttagcaaagggaaagtctgcatctttgggaagccctcgatgcctctgacataatagcaggtacaggcaggaatgcaatagacatgctgagtgaatgcaagagaaagcacccgagagaatgagagcactcaaaaccctgcagcactgtttgccaaaggactccctggccagagaagcttgggaaactggtccctaaactgaaggaatcctgagtaatacgaaaactccatattccagattcacaatgcacattaagacagtgaaggctctgagaattcctgcagttaaggaacttatttaatgggtagttgcagcaattgtttcacaacactaattttgcaaagaatctttttttccccagaatctccagtgggataatatatttaggaaatattgtccctggtaagcaatacatcagtacagggcagataccgcaagccccaatcccataggagctaaggagctaagttatttaaataagttaaatgggggcaggtttaatatttgcataaaaggcatatggaaacactcttcatctccatgaagaaatatgctctaatttttcagaaaacaaccattttggttcatcttttctcttccatctttgatagcaattgtttcctatgagagaaatagaaacatttatttaaaagcaatatagttctatagaaaaccaatgtgcaaaggcaatgatgaaaaaaacagagagaaaaatgagaaacagggttggtgggcactgcaggggctctgggggacacaggccctgtccaagagcacagccacattcagctccacttgaatattgccaggctaagaggttgatgccaatgatattagcttttccaatttttaaaaagaagtcagaaatctggagttctgagtgaaattcctcatttttaaatgttggctcaaattgtttaaaaaattgaaagggtcaaacaaaacattcctgggagctagagtcagctcaccaggttgcaatttctgccaaaaatgacagagtaacgctcattcgactggtgctgccacccgtttcccaagcttctctggccagggaaccctttgacaagggtttgagtacccttattctcttgagtgctttctcttgcattcactgagcgtgtgtactgcattccctgcgtgtacctgctattatgccagttgcattgagggcctcccaaagacgcagactttgcctttgctaaggcaccgctctaagcactgggccctcgcctctccttgggcaggccctggcatgtgtgggaaggggtgagcacacagtgtgaggccagaatggccagtccatcaaggggatccatcatggtgtcatgacaacactccctaaggtccttttcagaaatagaattcattctcaaatcaaaactaaaaacagaaagcccacctggagaggccagcaaaggaagacatagtccacgggactgagagagtgcatgtgtagcgggttggggtgcatgcttagtgggttagagtgcatgtgtagcgactagccggtgggaccaagacagtgcgtgtgtagctggtagcctgtgggactgagagagtgcatgtgtgtagcaggttagggtgcgtgtgcagcaggtacccatgggaccaagagagtgcatgtgtagcaggtagtccgtgggaccaaaacagtgcatgtgtggcgagttagagtgcgtgtgtagcaggtagcccaggagactaagagagtgcatgcatggcaggttagagtgcatgtgtagcaggcagcccacaggagtaagacagtgcatgtgtggcgggttagagtgcgtgtgtagcgggtagcccgcaggagtaagacagtgcatgcgtggcgggttagagtgcgtgtgtagcgggtagcccgcaggagtaagacagtgcatgcgtggcgggttagagtgcgtgtgtagcgggtaccccgcaggagtaagacagtgcatgcgtggcgggttagagtgcgtgtgtagcgggtagcccgcaggactaagacagtgcatgcgtggcgggttagagtgcgtgtgtagtgggtaccccgcaggagtaagacagtgcatgcgtggcgggttagagtgcgtgtgtagcgggtagcccgcaggactaagacagtgcatgcgtggcgggttagagtgcgtgtgtagcgggtagcccgcaggactaagacagtgcatgtgtggctggttagagtgcgtgtgtagcgggtagcccgcaggagtaagacagtgcatgcgtggtgggttagagtgcgtgtgtagcgggtagcccgcaggagtaagacagggcatgcgtggcgggttagagtgcgtgtgtagcgggtagcccgcaggagtaagacagtgcatgcgtggcgggttagagtgcgtgtgtagcgggtagcctgcaggagtaagacagtgcatgtgtggctggttagagtgcgtgtgttgcgggtagcccgcaggagtaagacagtgcatgtgtggcgggttagagtggtagcgggtagcccgtgggactgagagaatgcatgtgtagcaggttagagtgcgtgtatagtgggcagcctgtgggactgagagagtgcatgtgtagcaggaacacatgcacaatgacagccttattagaccctcataacagcccatgtgatatgtggctgaggctttatttaaatatttctttctttgtttttaaagatgaggctcatggatgtcaagtgacttctccaggtgatcatagtgacatttgcattcccagagacaaaagcagcccctgatgagataaggcagtgaccgagacatagccagtggtcttgcatccaggccagccagctactaagctgcccaggagaactacaggctgcagaaggcctcctgatcacctgcagaatcataggagatggaatgctgctctcacagatttctcagaagctgactgacagacactgcaatatgagaaatgtacacagtgtgggtatctgatcagaacctgggtgtgagtctctcagcagagcactagtagatccccaggggaacatcactccgcacagtaaaagaggcagaatcttctggaacatggagctggacatggccagctgaagaagcagaagccagcagaaaaggaggctcaggtaccaagggcacctgcaaagggaacaacgactcaagctggtactatggcagagatggctacctgcccccaaatattcctacttcctcttccacagtgtagagttgtcagcagaaggtagctgcccagatgggactacatttcccagcacctctttcatcagggtggggccatgtgattagttctcactaatcgaacatgagcagaagtggtacagaatgattcacagtcagggatcttaagcagtgggaagagtttttctactctcttattcccctttcaccaagtagaagcagagaactcagaggctctcacagatgaacaagccacaacatggaaggagcctggaccactaagtcactcattttccaaccaaggtacctgtattggactggtccatgagtgataaataaaattctaaacttcaatgtcaaggtgtctttactacaacaaccagagttgccccagctaaaacacaagtggaaagaaagaagaatacatgggtcaagaaaataagtcctcactggggtaagaagctcaaggcaaaagcaatacaggaaaaaatctatctgctaaatcagatcagtcaccacctcctacatacaatgcctcccacctgaatgcctctacataaaggtcaactttaagacccctgggtgcttagctatgcctaccttgattaagaatggcttacaaagacaaatactgcgtgatctcatttatatgtggaatctaaaatgggcaaactcaaagaagcagagtggaacggtggttgccagaggctagggaaaggaggaaatggaaaggggtgatggccaaggggtacaaagtttcagttatgcaagataaataggttctggagatctactgcacagcatcgtgcctatagctaacagtactccattatatatttaaaattttctaagagggcagatcttaagtattctttctctatctctttcacacaaataataataataaagagggcaggaggaaacttgggcagattatagacatgtctatggccttgatggtagtgatggtttcataagtgtatgcttattcccaaacccatcaagttgtatatattaattaagcatagctttgtacaagtcaatcatatctcaataaagtgattttttaaaataaagaatgacttatgaaaactcatttagggaaaaaagaaggttatttaccaaatatactctacccacccacccaacaaccctccgctgggaaggtattcctactatctccatcaacaagtgagggccacaaggtcaggaggtgtagtgacttggccaaggtcatgaaactggtagaggcagagcttggttttaacttaagaccctattccttccaccaacccaacctgctctgaatggtgtaaaatatttgtatcatttcccacaaatcactttctgccttgtatagggccagccaggtatggtggcctccgcaacacaatgggcacctcctgaaggcagggactcaggccatccatcagtgcagtctcacagggcccagcaggggcctctcatcactgactgcagggagtcacatgctgcttgacttcatgccctcacctgttgacggggatggtaggaataccttcccagtgggtcactgggtgggtggacagagtatacttggtaaataactttcttcttttcccaaaatgagtttttataagtcattctttaaaaaaaaaaaaaaagcactttattgagatatgattgacttgtaaaaagctatacttatttaatacatacaactcaatgaatttggggataagggtacacccatgaaatcatcaccaccgtaaaagccacaggcatacccacaatctccccaagtttcctgcagcagctctcaggccaaattctggtgcattttcaggatactcaggaggcttccaccccaaatcctgtcctctaacccagctctctccaccaaggataatcagaaacataacaaaaggcactgcttccacttctgaacaatcaccatttgatcatagcaatctggctatggatggataatcttatgagtcattcattatcaatatttaaaccaggaattaccatcactaggggttacatcttctttgctatctggaggaggagaggagagggagtgactgaatgtcttcatgtaattggacatgggggtgagtatagctgctcctcccagctctgctctgaggcttgcgaaggcaatacccacatctgcccaccatcaagcctccatctgaccagggcctgttcagggcctgggtgggaccctcaggagagtaagggcaaactagcatatagtcccaacaaaaggcaggaataagccaagaagctagcaatcaattctgggaactcagaatcttctagaatattcttgagcccaggtaggaggcttggtgggctctgcagcccagatgctcccctacggcagggtttctccaccttggcactgtttacatttggggccaaggtcactctttgttgcaggggcacatcctgtgcactgcaggatggttggcagtatccctgacctccacctgctagaggccagcagcacccccaacccagccatgacaatgagggatgtacccagatatcgccaaatgtcctgtgctaccatggagaacccctgctccaaaggatgcaacaaatggtggccacaccagaatttaggcctggtgttttcccattttccattttcttctatctggatttttatgtgatatgtctccatttttaaagtttggcaattaattaaatatttttatgctgctaaagccaaaaagcatgtgtaaaggtcactggccagagcctccaccaagccctctgctaagtccagatggaaaatgaaaaagcacataacctacttctcagtgttcgagctcctgagttcaagagcaagtccgtccccacagcccggggaaggagccctggaaagggaggcccacgttatttctggggggaatattgccacaagatcacctgtcaaaggggctcttcaaatcccttctcccaggaacacagacaaccccatttgttctttctccccgaaaatacaattaccctcgcgctgatgttctgaaaaccaggccctaagccggctctggcctatgaagcaaacacttgtgaaccacccgcctataaaaccagccagcctctgggcactggtgaatcttttagtgccaacgttaccccagaagactggcctccctatctctcagcccctagttaaagaacttgatctgagcaagtttcctttccttccagcgaaaatctgggttactagggggagggcagtagagaatctaataaatcttagaatatacttcttggctaaaggaaaaaaaaaaaaaacacctacttactggtgtcatgaaacaactttccagctctctcagaagacagctgggttcagaagttactattgtattcaagctgtattaaatcaagctgtgagaagcaccagggttatgcttttaaagaatgccctaagccaattctgatgtttaaagggaaaaggaaaaagtttccaaggcttccataaattccaaggagaggaagtttcaaacttgggtgttcacagaccatggcccccacatagaaacagcttggtttcatgtatttggttttactgttcaaactttagggtcttttaactttttatttttacagggctcagaagaaaagggagagggagccatttgctcaccaagtgccaaagaaaacccaagcgcctccctcagagggcctctgcctgggacgacaacgaggcaaggaggtggggaggggaccccctggctcctggcacgccccaggcacagctcctcctgcccgctggaggccaggcctgcgaggccagctgctaatgaactccaacaagatcaatccaaggcgagaccacgctgcactgccattcggccgtgcctgggcctcggccaccagcagcaggaggagcaaaatggagagtttccaaaaacaagatgaggcccagccaagtcccaaggaatcctaaatttagtccctgggggaagacggctatgtcgactcagccaggacaccagtgaggcccagcatcctttgaaatgtcaaccaaactaaacaggccctcccaggacacctcagcccccagttctgactcacacccacatttccaatccctagcccccactgtccaaggcctgtgtacctaggaggttgggcaagacaagggaggtatacccatttgacaggagagaaaattgagtcccagaagaggtagtggtgaggtagaatgaacataggcagtcctgcatttggatccagcatcaagttctatcacccaatacccatgtgactaggaagaagacattctgccacttggagcctcagttttaccatctgtaaaacgggagtgagactatttcaaaaagtactgaaaagacataaaattttaaaatttctatgtatatatagacacacatgcattatatatacatacatatatgtcatatacatgtgtgttaaaaagagactgctgggctgcaccccagacatatatagtcaacagctgttgtttgtgccagctcagcaccctcacccccgcccctgctcccctctcagcccctgtggctgaggccagcccaacccgtttccgtgagagttctcagacacctaactgaatcagaatcaccaggagctgaacccaggttattcaattttccccaagctattctaatacacagagacacttttaggagcagctgccagataaattcagaagatccaagtggctaagctcagagagggtgcgaccctcctcctagccctcaggaagcggtacatctgcaaagggtctcagattctaaagggctgtcagggtgggaccctctcccagctctgagccaagatgcagaacccagaaggggaggtcctgaggggcagagaccagcagaactctgatctgaccccagaaagcacttgctggctctttccccgcagcacccggcttcacactgcagggcaggtcaaggggatgaagaagagcccagaagctccaaagggcctcgctttaacctgatggggggagaaggaacagggaatgtccacctgcccacagggcaacttcagcatcaggaggtctccatagcaaccctccagctggagtcattcagccacctggagaccagacagggtgcaggggggcaccacagggattgagattgtgtggtgctgaaggtagaggtacgggttccagcaaagaaagaaataacaaagaccttcccatggcggggaaaagacttccagaaaggactttcttcttggagggaatgataattagtcataagagcagccttactgagcacctccaggccacacagttttactgattcacacaccaactccaggaggaagattcaactactagtttcgctttacagatggggagactgaggcctcagaaacattaggaaagttgcctacatttgcacaactgctaggcagcaggcccagaactcaaactcatctgattccagagcccactctcccaccctcttctgcacggggcaggtcagcaccccttccgacctcatgatcctgttggctccagagactgactttggtcagcactctttctaacctccacatctcctgggcttgaaagaaactggctttggatctgtctctgtcggactcagggacaagctcaagcccggacaccgtgctgcacccaagctgggtaagaagacgaaccataggggtggtcagcactcatttttagagatgggcaaactggtgcagagaggatttctctgattcccagagtcccacagcagatcccctgaaccccttctcaccaatctgccgcctcccctgagttagagcacaaaagacagggcggagcagacaactccactacccccagccatcgagccaggcccacgtaacacacggggttcattccccaaaaaaatccaagatggaagcaactacccccaccctctagtttacagacaggatagctgaagctcagagattgaaagaacttgtccaaagcacacagcaaagcactttcattctccaaggattaacagatgcctatatgtgtcaggccctgtgcaaggctgtggagccccaggagttaatgacaatatcctgccccctgccaccagaggggtgacaataccctgccccctgccaccacaggtgaataacaatatccacaactccttgctgttcctgtgggaggtgagcagtaactcaactgccacatgaataagtcacaaatgaccaatggtggtgagcattccaaggaggcagaaggaacaggatgttaggagaaggaaccacagtgaaagctgctccaaggcacatgtgagagctccatcctggagggtgagctggggagaacaagggagagtactgggaagcatctccagctgcaggaatagagcgtgcaaaggccccgagttgggcatgtgatgggtgtgttccagaagggagcagggcggctgggacggagtgaggtgaagggcggccggggatgagaagcaggaaaggggcaggttgtgctcagccttatggaccatgggaaggaatttagatgttcctctaaggactgtgggaagccgcagtagagattcaagtaggagagggagtggatctcattgggttctgcaaagtcagcctggctgaggcagggagaagaaattcagaggctgttggagtcctccaggagcaacaggatgatggcttagaagaggatggggaccatggtgagcagtgggcaaatctgagattcacagagtcatagattgacgaaaggtgtccatctggcagctctgcagggaaggaaggggaggagttaggaatgaccccccaggatgcctctctgagcaacagatgaatggagagcccgtcactgggactgggaggctgggagcgcagatgggtctcaagagttggtggggaaggctgcttccgacaggctgtttgggtgtgtgagcggcagtgagtggagggcacccaggtcttcggagcacttgaaactcccaaggtccctaccaacccccaaagcctccatgtgcacaaaccctggttccaccaggctgtgcggccagctgctcgtcctcatcctggctgcattgctgaccttcccctctccggatcacatctccccacaggaggcagagccctggcctctgtgtctctcaaacagtgatctccaaagacagaatttgggtttgttataggagggctgccacctgcagccccctaggccagagcccatgtcactgacaatttccaaggccttgaaagggacctttaatccaactgtctgtgttgagcaggccatgggcagcccctccttcccctccactttcctctcagctctcccttcaaaggcagccccagggaggagatgtccagcacagcctggccctgacagcgggacaggtgcacacccaggagggtccgccatgagcccagtgaaggataccaccagccagccctcagtgcagaagcctccctgtgcctggcacagggctgctatggctggggtgggggctacatcactccaatacctgccagccacattccaccctcagcacaaggtgctgtacagatgttaccgcactcctggcaacacatttcccagatggaaaaaccaaggctaatagacatggtcactccatagatcctgggagtggaagtcctaccccgttctgcctccaaaggctggccaagcttgtcacatagcacgtgaataataactgtcctacgtatcacctgctttctgtggctagctacggagctaagtgtttcacaggcattctcatctgatctacatgacagcttcacgagctaagcaccattttcactgccattttacagatgaagaaacagagacacagagaggttaaggcactcgcccaaaggtcacacagctagtaagtggcagggccagcatctgaatcggtcctggctatctctggggccagtacagtgtatctcagttcccattatcttccctcttcatacagagcctgtgtagaccataacattttaatatcacaggtattctgtggatctgtttatatactggatgtatatctgtgttttatacttaaaaagactaagactcctttgccccccaagaaccaatttctgcctccttggggtcaacatcatccccatggagtcaaggccagtgctgtgtgacaggaacagaatacaagccacacatgtaattttaaatgttctagtagccacattaaaaaacaaagaaacaggtgacattaattttaacaatgttatttaagccaatatatccaaaataccgacatttcaaaatactatcgttacatgtgatttttttaaattattaataaaaaaaagttgacatacttttccttttctacgttaagattttgaaatcccctgagcactcccaatccagacccgccctatttcaaacgttcagtggctgcatcacgacagaggctgccatggtaggcagtgcccgcccggctccaaccactctgctaaagcaatgttctgcatcttccccaaaactcctgaaaatccacctatgcgggacttcctccatccaaggaaccccatcactcctaaccagagggttccacttaataagttcttggacctcctacagacaagacaccatgctaaaaagctcacaagatacaacaaggagtaagaactggcctctaccctcaagcagcctacaatctaagtgggaggagaggagtgaaataattaccaaccctactgcacaccaggctctggggcttctcacccattctcttaatcttcatactcatcctgggatatgggttctattattaccatcccattttattggtaaggaaattgaggcttgacagaccatggattttgcccagggtctacttatttgacttggccaacccagggcagaacaaagatgttagcaaagccatgtggaagcttttaagaacaaggagggcagcttcagagagggcttcagggagggcgtgagtgaacttggaggcagcatgaaagggaagaaggaagcagagagccaaggataaagcaggggtgtatgtatttgcagggaacacagaagcaataagtgcatttctcatgggcgaaactgcacaagcagaaccttggaagcaggaaaaggggccagaattctgggcgctaaaacgctgtagcatgaagctggtgcacagcgcatggtatgaggatagtccaagttcaatcacccagacatgggaaagcatccactgcccaacccatagactataatgtcagcggaatctgacttcccaaaatatttatcagaaggcgctgggcaccagattccattctgtaaacctggatgctgttccaaagctgagatgatagatctcccagagaaccagataaactctccctcacattctaaataatgaagggaaggtggggaagagaaggagacaaatcaaccttctccaactgcccaacttaaagggattatggtcagaagcaagacgggagcaagggagccatctccttatcaggcacacggctgctccagacacagacaaaacttctagcatgcatccttcttccacattgggggagagaagcacccagtcctaacacacaaaggtcagtcccatcctctgggggggcagaatttcaagccaatctgtttccccctaatttccaagaaagaacagtcccttccatgtacagaggtgctgactggagctcaaagaatgaggcccataaatctccaacctgctaaggaggcccagatttcaaacctcccagtgcgccggcccactgcactcaaaggcacaagcaaaggaagctgtgggatgagtagattcaggaatgtggatgaaggaagacccccctctctcgctgccaacgatcaccatagacattatggactgaataaatgaggaagcgcttgacacagatgctctcacttaattctcctgaaagcccatgaggcaggtcctgctgttatccccagtttacaacaagaaatgacagaatcacatggctgggaaatggcagcaccagctctaacctggacttcctgtgtctccagctggggccccccataggctggcctaccactctcagtttcttcccctctctgatatgcggtcctggtttcaagcccagtgctaaccacgtctcttccctgttcaacacccttaggcttccgtgtgcttgcaaaataagccccaaatccccagagatggttaagaaaaggtaggcgggtgctcaggggccccccaggccttcgcaagccaattcatgtcacccactcccaactccaaaaaaatgcagcccaccccctcaaagggcccatccaagaagcgggctttctggcatcatattttcctcccacagaacgtgagaataaagggctctttgcttgtctcctgaaataactggctctcgccataaagcaatcttctgcccagtaaaaatatttctgtaaaacttggtaactctatctgcggttccttttctgaaagtcaaaaatcttggggagtgaaatatggcagaggccagttttatgacaagctcatgaagtcatgtctacccgagacaggccctccttaacactgtgattaatttgctgttaaccacagggactttgtgtcttaatatactcaaagcaaagcaccagttcacatttctaccagaacaatacccaccaccccagacctggtgtccagccaggcaggtagcggagccatggctgggatctggggccagaaaggactcagttgagatcggggactctgccaaagggccataacacacaagggagctgtcacctgtggcctgtccttggccaaggaggaggtacagcttataaaataagtgaggggtgtcccgagatcagagtgtaaaaggcactcacagctaaaccaaactaactccaagacacctagagaagcccctgaaacctccctagggctgggttttcccatctataaatggggagcaatcatctcaggggaactcctgagcaatcaaatgtgatgtcccctctcaacatcttcttctgacaaacggcaatcacgccccttccaggtgctattttcggccccaaagaaatggagaccggtttactgggaatctttcagaacacagcagcagatccagaggccttaaagggctactgagtacatctgctgggtgctcactgcatgctaacacttcagtggccatatgcattacttcatcatttaatctttgaaacaactccaaacggtgggcattctgttcctctttttataggtaagaaaactaaggcccagcgtcaacacggttcagtataaacccaagtctgaagcctggtcctaagctctatgcacccctcaaattgggagatcacatagggaaaaaggagtgaagtaatgcaattaagtcttaaaaaaaaagggggggggccataaaaactaaaacaggagttcctaacctggggccataggtgccctgaaattggaatgacggatgtaagagcatttatctaaggagagagacacaagagatttggtggattcccaaaagtgtcttgttactcactccttgagggttaaaaatcatcaacctatgatcatcatagagaggtcagaagcttgaaaggaaggctgtaacccaggtgggctgcatggaggaggtggcaaaccacctaggttcttccaagatccaatggcaatgggtgggtcaatggtcagctacctagctgccctgtccttacccagccttgccagctgctgaccagagccttgttcagtgattctgattccagggaccaggccatccacagctgttggctccacccatacagtgtgctttctacagccttctcctctcaagtcagtttctcattagggaggttcaagggatgcggggacgggggtgatcccagcctccactccaggacaggcatgtgacccaggactgtcagaggcacagggatgggttccgggatgtgacccaagtcaaaacaatgggagctccgcctgggtttttgctggaactttcttctctaacaactgaagctgggagtctggactgctgggagccaagttgccattacctgggaagggtgtgcctaaggatgaagccaatctaaaagaaagcagagatgaagacacagattgctgtcctgggacatagtttgggctggtggatccagctgtaactgaagtccactccctggttacacaagccaagaacttgactgtatgaaacagttgacaagggcttgaaatccaaaaggtcccaacggatccacagagaaagttcacacctacttaaccacaagctccccctgaagctgctttcctcctcgattttgtagacaccagccagaaggaaaaactccagctttgccagaaaaatagcagagccacacctggtgatcatatcaggatgtgcagtgtgtgtcgggggcacagggcaaggggtggaagcagaaatgcacactgttgctctaaagtcgaccacaggcagaagcccacaaatgatctaaatgcccagtagtaaggaatcaatgcaatgatggtctatccttataacagaaggcttgatagccatgaagaacaataagattatacattctgatatgaaatgatttccaagataagtttaaaaagttatgtattaagaaagcaaggtgcggagacagatgtatacatgaatcttaagttaaaagaaaatcttaagttaaggtctgtatcacttttcattgtagttgctgagagacatggtctcgctctgtcgctcaggctgaagtgcagtggtgcaaacatggctcactgcagcctcgaactcctggccccaaaccatcctcccgcctcagcctcctaagtagctgggactacaggcacacatcacaaacctggctagttttttgttgttactgttgttattttaagagatggggtcctgctacattgcccaggctggtctcaaactcctgggctcaagcaatcctcccactctggcctcccaaagtgctgtgattacaagcatgagccactgcacctggcttctatatcaccttttttttttttttgagacggagtctcactctgttgcccagactggagtgcagtggtgcaatctcagctcactgcaagctctgcctcccgtgttcacaccattctcctgcctcggcctcctgagtagctgggactacaggcccacacctgggtaattttttgtatttttagtgaaggaaacacggggtttcaccatgttagccaggatagtctcgatctcctgaccttgtgatccgcccaccttggcctcccaaagtgctgggattacaggcatgagccaccacacccagcctctatatcacttttttatggttctccaccttaaatgaatttttcaattaacctgcaaataccaatgcttcctggtcttgttggccaagacagcttctgctgtctgtgcagggataagcatgcacaaacagagcatggctagaagtatcttgaggagcccactacagcagatacctccaaagggggaagctgggaggtggaggtgggcggaggcttcctgtgtactgcataccttcagtactattttggattttcttttcttttttttttaaccatgcgtacgacttaatttacagaaaggaaaaaggtgaggaccctttctgaagggcagaggctctcttcaaagacacagaacagcctggctccataaaagaggtggggacttggacagaacagaacagaatccctgcctctctggctgtgtgccctctggccaagctgcatggcccctctgaacctcatccacctggaaaatgttcttgaggatctgccatgtgccaatcagtgcaaaaggcccagggatacaagagtgagccacaaagaacctgacctgtggactttacagtctggcctcagtttccccataataataattttgatcctggccacatttttgtgaatattaaatgcctgacaaagccctgtgaggaaggctttgcaagccataaagccctgggtaaatcctggctggaaaacagccacccactcaatgctgctgcctccaactcagcagggagtttaccttccagtgccccagacccagagccaagaggacgagacgccagtagcagctgctgagcagaacctccaaggttaagaaggctagaaaggccccgatttgtgacatcacaagaaggtgctctgatccaaccatctagaaggaagaccatgatcattccccaccatggccatggctgcggccagccagggctaaccaagcctgaacacagctatgttacaaggaagggggctctggacaggccccaaagacggttaaccagtacttcctgtgggggagagctttctttccatgaccacctgctgtgaatcactcctttgcactcctttgacgcctccctgcccactgaggatggagtttagcctgacacacagggtcttctccatgcatccagggctgtgcccactgaggatggagtttagcctgacacacagggtcttctccatgcatccagggctgtgcccactgaggatggagtttagcctgacacacagggtcttctccatgaatccagggctgtgcccactgaggatggagtttagcctgacacacagggtcttctccatgcatccagggctgtgcccactgaggatggagcttagcctgacacacagggtcttctccatgcatccagggctgtgcccactgaggatggagtttagcctgacacacagggtcttctccatgcatccagggcttgcccactgaggatggagtttagcctgacacacagggtcttctccatgcatccagggctgtgcccactgaggatggagtttagcctgacacacagggtcttctccatgggtccagggctgtgcccattgaggatggagtttagcctgacacacaaggtcttctccatgggtccagggctgcgcccactgaggatggagtttagcctgacacacagggtcttctccatgggtccagggctgtgcccactgaggatggagtttagcctgacacacagggtcttctccatgcatctagggctgtgcccattgaggatggagtttagcctgacacacagggtcttctccatgggtccaggactgtgcccactgaggatggagtttagcctgacacacaggatcttctccatgcgtccagggctgtgctgtccaatgaggtagccactagcctcatggggctatttaagttcacatttaaattcattcaaataaaatatatcttaaaatttaggcagtctctgagtcccagtggtcacattctaagccacaggttcccagaggggacaatgcagacacagaacatttccatcatcagaaagttctactggtcagcacagtctagaggtcacttctacagccccttcttctacccattctacggcggggggggggggtggtggtgggacctagcagccctttcaagagaggcaggtgtcagtgactgccagggtagctctaaatccgcttgcaagtttaagcagccacagttatggggatgtgggaagaggagagagaaccatggagcgagagcttgtcatgagtgagggcctgcactggcttctctgtagggtcgctcattaggtcccgctacactacaaatggggagtgccctcctcccccctcatccctctccaactcctgcaccctcctctctcctttccttcagggtccagtcggcccagctgttgcctagtacagaaaggttctgactcaggctcaggaaaccccaaggagtctacattttgaatagcacccaagagattcagatgtaggtggtcctcggccgcatcgagtctccccaactccacaccctctggctgctgtcttctctctccactccttctgataaagcttctccatacagttgcctacacatgctgtttcctcatctgtcattcacttttaaaatacatcacctttttgaaaaatacaaaaagtagcacatgctcattttttgtaaaatcaaacaacctaaaaatgtacaaaatgaaaagcaaaattctccattcctcagggaaatagtccttgacagtgtacccttccagatctttctctatgcacctgcagatacacagtgacacaggcctgaatagactttttcacactgtaagaaacaggaccatggcctatgaatgttttgcagttgctttgctcattcagcagcgtctcagggtctctttcctgtcagcaagagaggcccttactcgctgggctttgaccagttgcagagagctcaatgagaagtccacaccactgttaccttgtaccctagtgatggatgtttgagttgtcaaaaacttttcattcttccaaatgcagccatgaatgttcttgtaagtatgtgcttctgctcccctgcacatatttcttagtcccttcgtgagccacccaagtctcacctctgctgtcacttcaccaagacagttcctgccagacccaactgtgaccgccaggatcctaaacccaagggacacgtctcagtccttttctataactccactctctctgcaagagaccacctactctccggtagactgtgtggatggcccccagtgaatcccacttcccagtatttatgcccctgtgtagttccttcccctaaatctaggctggacctgtgacttgctttaatgaagagaatgtgttgttgctaattccaggcctaaaccttaaagagtcctggccgtttttgcttctatactcttgggaaagacagccaccatgtaaatctgattaccctgagactgccatactgtgaggaagcccaagctactcatgaggtgaggccaactagaagagaactgaagccccagacatgtcacttatttggagctgctgcagtcagacccttgctgttagagccaccctaactgtgctacatggagccacagacaagttgaccctcccaggcttggtccaaagtgcatactcttaagcaagtcacaaagtgatcaagtcactaatctttggactttttttttttttttacagcagtagaaacaaagccttctcctttcctttaatgcatttttgagaggaggaagcagaaggcaggagaggtcataatagatacctcatagctaagctggaggcacccccaggctcagggttcccagcgcagcattgtgtccaacccctgatgactgagccatgtctgtgtttctcctgggatgaagctgctgctgttggcttctcaggggagaagccatgggccccccctccatgggactgctcatcctcttcattccctaagcaaagggagtgagccagcagcaagcacccacagcatccctgggagcactgacccaggcccaaaagtcaacaaaccaaacagctcagaaagcacagagaggtcaggaaagttgccctaggtcacactgctagtgagaagtagagccagggctcaaaaccaggcattcaggctcagggcctgcaccagtgacccacaccagcgtttttctaatactctgattatgacctatagtaagaattatattttacaatatgcctctgctgtagatagatagatagatagatagatagatagatagatagatgggtttgggtataggtgtgtgtaaagtgtgtgtatacattttttttaactagaacaaaaaattacacaaaacaatatttactcttactatatataatgttttctcatatttttactctatttcattttggtcactaaattgatgtcatgaaccatgaatggggctgagacatacagttgaaaaaaaaaaaaaaactcgcctaaactgatttaagatggctctaaaatcacactgagtgatctgaatttgaatcttgctgaagcaagattccacttccaagttaagtgaccttgggcaatatggttgacttctttaaagcctcagtttccctatgggtaagatgggcataataataacagcggcctcataacagtgctctgagaatccagcactatgaacagtgcttggcccagagcctggcacacagcagacacgcagcaagcagcagctacgctgttaccacctcctcctcgggctgcagctcccagactcagcacggggctatgcacacagtgggcagctcgcgggcacactgagcctgcagccactgagaaagcaggcacgtgcccaggaccagctgaggcagtgggtgcctttggactttccagggcagggaggaagcagagaaagtccccagtgcccgctgaaaaggcaactttgttcctggattatagtagttctcttcaatcatctttttgcctttgaagggggaaagaagggtaaaacaacaaagtcagggtcaaaaactgtcctggaacaaggctccctctggaaaccaggcatggaatgggcatggcaccacacaccagcacccccaaacccactcactggagccaccgcaagccgaggcctctgagtgaggggcccaccagcccacgcagccttctgaagttagaaaaacatcctccggcctgagcccattagggaggctgtggcctgagggaagacagccccatcctgctaacagggtccttttatgctctgcctctcccctcctcaggaccccagctctatgctcaaggccagaaggcttgggcagcccagcaggccagccaatccgctccagggtgacactatttcttgtgactgagaggttctcctccctacctcttccaacctgaccagaaagctggagtccacagacaccagtaacacttcatggaagacttgcggcaaggagacaaggcctcatgacgggatgcaacatacagtggtaccacccagcccagcaggcactgcccactccctgctgctgcaccacatagttctgctctaacacctcagagactggaatgtggttccaagtcagacaccgagaaggaggctgaacactttctctgtgcaccaaccctgcatgcctcttgccctttgcacatcccgtgccttctgcctggaatatttttaataaacctttccccacctagctatttcctatttattctttgggtcttaacgacttacgcatcactccctaatctgaagtagaatcctccgttattctccttccccatccttttccttcactgcacttagcacactggtaccacactgagcacacatccaggtgatcactagcaaacaacactggcaagctgcaaaagaaggggtgacatctcctttattctttaacttgctgaaatgaacccatttctacccttaaaacaacccaatgaggtaggaaccattactctacccattccacagatgtgaaaactgagaatcagagatgagccatcacttggcccaaggccaccgagctggggagaagtgcagctgggactcagacccaggaagtctgattctgcaagttctaagcacacctctggcaccttctatgggcacatgctggtcttcagcataaagtctcccagcccacatctttgttttgttgtttgtttgtttgtttgtttgtttgagacagagtttcactcttgtcacccaggctggagtgcaatggcacgatcttggctcactgcaacctccatctcccgggttcaaggaattctcctgcttcagcctcccaagtagctgggattacaggtgcctgccaccatgcccggctattttttttttctttcttttctttctttttttttttttttttgtatttttagcagagacggggtttcgtcatgttggccaggctggtctcaaactcctgacctcaggtgatccaccaacctcggcctccaccaacctcggcctcccatcccagcccacatctttacttacccttcctgtgcctcccacattgctctcccaccagactgaaatacactgtgcacagcttcctggcaatgagcctttgcttggcctgcactctctgccttggatgcagcctgcatccagctctccctggctgggctagtgactctaatttgctgggcctgcctcctcatctatgcgatagcggaataatacctaaggcagttgtgaggattctacaagagaatgcatggaaagtattaggcacaatgttgagtccatatgatactcactcgtgtgtccttttatcactaacatactgcttctctaccaccaccaccatcagaatcttaaaggtctaaatcagcaaacacaagccagtgtactaacaggccaaatccagtcgtctgagtcacccaaagaaggtgttttctaaaaattttaattggttaacaataattttttaaattggaaaagtttcacataaaaattcagacagctggattttcttaatgatcagcccgtgtggcaacaccagggccatattcccacatggcagtgattggctggggttgagtggcactgcccccttgaggcagggtgtgtgttccccgggggcaccccggttcccacccctctcagatgtctcccactgagcctgtggcattcattcatatgacctctctggcccctgtaggtccttaagtttctaacccctgatctcagtcttaccattcttcaaatccctactcacatgcccacttccttcaaaaaaaccctccccaacctccacagccctgtgcttcccttatggttttataactttaacagttaacttgcactgagtacttcatgcaaagatccaaagtaaaatattagcctatcaaatgcggtcacatttaaaagaataatctatcatgacaaagaatttcggagggccaagaaggttgcactaggaaatccagcaatgtaaatcaagcatacaaatcacacaccacattagcaaagaatgatgcattccatctgcatcccaacagcatgtgacaaaattcaataattattcctgattttacaaagctcagaaagccaggagttgaaggaagctttcttaaacaaaaagtatcatacttggtagttattaaacagagtatgagattctaaccaatgcaatgagattctaaccaatgcaataagagaagaaaaatcgatgaaaggccatggggagagcttagttccactctcacagaggcaagaactatgtcctagtcctcacaatttccacaacaccctaagcacagcacgtgggatagataaagcagtcaaatatttgtggaatgaaaaacaccccagatgagttctgatccctggtacatgttctcaaaacatccagtactttttggaggcacatatcacaacttaaattgcacaacttgtttatgaaaatatttctgttttcctacaagatggtaagttccatgaaatcaaggccttcactctaggtaccaagcacaggtgtccctggcctaaagcaggtactcaatgcccactccaagagacatgagggcctactggagggtgcagggtgggaggaggctgaagatctaaaactacctgttgggtactgtgcttattacctgggggatgaaataacctgcacacgaaactcccatgacacacaatttacctgtagaacaaacctgtacatgtaccttgaacctaaaataaaagttaaaaaatatatataaggctgggcacagtggttcacgcctgcaatcccagcactttgggaggccaaggcaggaggatcatttgaggccaggagtttaaggccagcctgggcaacacagtgagtccctgtctctaaatttaaaaaaaaaaaaaaaaaaaaaaccctactgcagatgcatgaatgaatgcactcaatagatagtgctaaattatcatgatgttattctacttctcagctggagaatctgaagcccaggcagggagcctttggctgaggccacaccaatgtgaagccctctcagtaccctggtgtcctctgaaaggcgtcggccacacgcacacgccacagcccatgtgacttaacaagtaaggaaagcaaagcccagacccatgcctcagagccctctaaacaaacacatccaggacccaccccggcgggccaagccgccaccgctctgaggctggggatgacttcagtgcggagacctgaggctttcctcccagagccccacgactggtgcccacaaggctaaacagctcccttctgccttcccaggaagctatcaaagaattacttatgtctctggaagtgcttgtttagaaaaggttctccaccccacctgggcttggcaggagcgcagcatcaccaggctgcccttcggagctgctcaggcttgcctccagcccctggaggagctcagccatctttcacacagagagtcgaagccatgaagcagcgggaagcttcccaggataaacggagcagggtgacatcaaagtcctccttccagattaaacaactgaggccttcaactctcgcttgcgttccttccaggatattctgggctcctgcctcagttctccctccgatggaatggcagatattttgtttgtgagagactgaattttttccttcctcagggagagggtgggggggaagggacgtggggagggagaggaagagaaagaacgtctgtgagagacaagagcggcaaaaagaacacgtgtgagtgggcaagagagagggaaggcagggaggcagccagaagtgcctggtttggaatccaacaagtgatgtgaaaagtccaaaagtgtctaaatccaagcatcttgtgattcgcagccatggggctgcaggaccccccagctcaccagtaccggggggctgcacatcctgtctcggacagccctgctcagcccacatgggggaccctccttccataggcacaggcgcgctgcagttctggggcatgattagctctctctggggtttgctggtcactccctcttgttccctggtccctgaagagcctccttcttgagcagcaacctcaccccacaggtcctccgcagccctgacagctaagcttccagccctgcagctgacctcctcccccaacacaacagcagggccaccaaccccaacaggccaggttgagcccccaaggacctgtccatgacacaggggcagcacgctcgctgactgcccgccctgctccacccaacatacctgtccagggggacagacaggtaactcagatgtgccaagagccaccaatgcacgaggctttccacagacagtgccaggaaccacttccagttcccacaggctgcagagccatttggaggccacattcccttcttgattacccgcttgattccacacagaagcctcccggcaatccccaaccccatcctaccagggcagcttgagcctggggcctcggtcagctcttccccccacctccaactccttcctcctctctcctcagcctcagcggcccatcctgccccctccctcccagagtgcctctgtgtggtcctaggagtgggcctgggtactcactgctgctttgtccccttcatcagactggatgccacaggagggcaggaaccacatctctcttattctccactgtatccccagagcctggcccagttagggacttattaattcataattaataacaaggccaagtgtggtggctcacatgtgtaatcctagcactttgggaggctgatgtgggaggatggtttgaggccaggagttcaatccagcctgggcaacaaagcaagacccgatctctataaaaaataaaaatgaattagccggacacagtggcgtgcacctatagtcccagctactcaggaggctgaggcaggaggatcactgtgaggccacagtgagctatgacgccactgcaccccagcctgggtggcagagtgaaactatgtgtctaaaaaataataataataaacaaagaattattgataataatttatactaattcattaagctgagtgcctaaaagaaaaagcctggttccacccttccactccagacagaaggacctgggaaaagatggaatttggaagcaggaattaaaggaaagaagctgaccagggaagaggagctggggaaaaaggaggcagggagggtgacctaatctatcttcatttctttcttctttttttgctgctgacagttcagccttgatgtttcctgccctcgcggggacagtttgatcccagagtgtacctgagcttcctggtacaaacaacaacactgtccatcgatccatccatccccaccttccaacatccccactgggcgagcagaggaaacatcccctgagttctaggaccttgcaggacccacagcaggtgcctcctggatttgatttcccccaggtttcctacaaaaatgtgaatgaagagggtgctcttgggctctagagaacagaaggcatgcacagtctggctcaggggcatccagcctccttccccaagaagaaaagtctcaaagtgaggacaagacactcctcgaagcctctaccggagaccacatcacaaagacccattaaagcgctaagaagatgacacccatggccgccacccacccatcctgagggacctatggaaaaccagaaggtccccccactccccagcactctgcccagcccaagctctcccagcctctgcctcccatcccccaggaggaaagacagtgcccaggctgggccaggcagctggccctggtgcccatgagcagaggggaccctccctggagaactcgaaaatgccagtgaacaaggcccaaacacctccatcctgagtccttctccagccttaaagcaaatcatcttttaatcctgaaacaccaaatatttaatttatgctctacctcaaatgtcaagcccacctcccatcacatagctttgaaaccacgtaaagaagcctaacactttccatatggcaaagacatggggccttttaattgtgccaactggtatcattcaagggtaattcccttggaatctggcactcgggcaacagctgggccagcctccaatctcatcacccaaccccacacgtccccatgggctccaagtaagcctgcaccctcctcatcttctccaaatatcaaagtgcactaggtacccccagtcaaattaccaaactgcctggcagccgcctttgatccagaggcgggcttgcctgcaccacggctctcagcctatttcttcaggcagctctgctgtaaaggaacaaaagggccaaccggggccatggggagattattttaaatctggttgtacatattcacaatcagcctgtgagcatatacagaggcacacaggtcttcaccaagtgtttcccacctgatacctgagtccactgcactatttaatctatctattaagctttttcacttgtccattctattttccacacccagtgtttccaattggttttcttctctaactgcctgttgctgcttcatgtttccagcatcctccgtttctctctgagtttatgatgcttattttgctttctaattgtttaacatggtgttctttgccgcgtgtgctgatcagtttattgctcctcttccacagtactcgtgcgcctcccatttctcattccttttctcctatgagtccatattcccttggacttgctcatgtccccatggaaagggcaaaagcccagcccttggcctgcgtccctccaagtgagcctgccatgacagtgggggaggcagagagcctctagcattcttatcccagccctatcactccctgtttgtaggcccccatctccaaccctacaaatgtcttcagtgaatctcccagtaggttcccttccttcccaggttcaacagttataatcccatcataacccgccagggatgaaaatattattacacccattttgcagatgagctaattaaggtatacaagggcaaaatggtttgcacaggtgacaaatcactaggacagagcctgacctcatttatttctgtatttaagagggcaggcttagtttaatgccagcatggtcaccctttcacatctcaggaccctgcaggcaacttggactcatctgggacatttcccaagcccctcagacctcatcaggaaggaagagggcaaacaggggccactcctgcttctgcctgccccacgactggctcatctcgaagcaccccctctctgggagttttgtatgtagcaccctccaggcggatgccctggcacagggcttctctacaaatggcttctcctagaaagtgctccagaaagggagaaacacacagtccacaccagcgggctgtcaacactacaaggttatggggaggattaagataatgtaagcaaagtgcttgacacatataggcacttaataaatactagttatcattgcaataacaataatactagttggatgagccactgtgtctccagccacttagttgacaggccacgtaaaggactagaggcagagactagccccaaaacaggcctggggttggtgggaggacctctgccagcccttggaaaccagcagactttggagcccatgccctcctacatcctgatgatatcatggaagaacctaccagctaccccttcggcaccagagggaatcagggaaatgaactagcctgagggttgcccattgctgtcctgttcaatatcttagtgcttcccaaacttggggcattccattcccacattcacaattttgaccacttgtacttaatatttttctctgaatggacttcacgttagactcttttttaacttagcttcatcctaagcaataaaatctgcaaaatcatgggtttgatgtcctagttatttttttttctggtaaaaaaaaaaagataactattaagatttaaaatgttcccccagattccacctgaaatcacctggaggatgcctggagtgctgttccacaccctgggctccccctgaagttctgactccttatccctacctctgcagacacactggctgggccatctggggccaaggttggtgaaaacccaggcgtctgggtccccagcagcaagaacaactcccaaggagacagaggccggccccctgcataacaactttgatggctgcggcccaccctccaaccacctgacacatgtcatgccaacggctctgagcctcacatcttcaaaagtactttgaacaaacattaatgacctctcagcatttctctgagagagggggtgagggagagagggggacaggcaccatcccatgctgtcctcagctgggggaagaaactaggcaacagaattccgtgacttcaccaaagccacagacttaagctggggccccctccccaccctccctcacttcccccaatggcaactttagtggcctgcattcctctcgctgggaacactactatttaattaaaaacgacagacttttgttttcctctccctctttcctcctccctcccatcctcccagactggatgccaaggagacccaccaaaaacatgcgggtaacatttgttatggctttgaagataaaagtcaattgaagtaagccctcgctgtatttcaagttttccctctagcatggagcaagctgcctggcagtttagaaaaaaaagaaaagaaaaagaaaaaggagggactgcaaataaatgtcattctgcaggaatactttgtaaaaataaacaggctgaaaaaacccaaaacttgattaatggaaatccactcagttggcctctgtctggagctgtaaatgcatttgttcatacggctaaattagaccgttttcgttggcctttaaataaataagtagatcaaaaactagaaagggcaggggaagaaggagaggtttgtagttctctttttaaagggccccaactgcagtgccccccgcccaccaagatttgacctttactaggggacagcagctccaagtccgacccggccaacagaagacagagaagcccccagctaagcagtggcggtggaggaggacaggggagcttctcctaggcccagaggttatttcatccacacacaggaactgactttatccacaggtccacctcccgacaccagcactgcaagcgagctgccaggtcccaccacccaaatacaaacacatctgaagtctccactggcctctccccagcccatggataagaccaaagaactaaccagacctgagactcagtctattccccctctaagttaaaaaaaaaaaaaaaaattaaatgtcacatcaaaaagttgattcatcctttgatcctaggcttgcgcgagttccacgcagactgcctgaaagccccgtgcagagttccggagctcacaggacatctgtgaacgccaagtcccaggccaggagctggggctggactcactcattcccatcacacttagtgctcctccaggaactccagcctcagagacacacggggtgaaggctcagggctctgcccaggctacagtggaatgaggccctctatctcatatgccaagtaaggggtcttccaggtctcagtccccctagatctgctacccagagggccgcctgctctactggggttcctgtacaggtggtactgatgaatgccacagacaatcagaacatattcagatcctggggccagcacagctctgccttccacccagacacccctaatacccccttctctctagcccctactccacctccacctttgaatgctggtggcagaaacaaggtagaagtcagagcaggcccccaaatcccgccggtacagacacgattccccatcaactggaccttcaccacctccccacctaggacctttcccccaggcagccctctgcctccagctgggcacttcgaggttctccaaggcatgcgggcagagggtcgcgttggtggggcagggggcagctgagaagagattttcagacccagaagctgtgcaggaaagtgctcaaagttggggtgcatgggtttggggacccatctctgaggctgaaaggaggccaggaggtggggcaggggtggggaatcatacccgggtgcttcggcctatggtgcccgccaaccgcagctgtcggggtcccgagacaccgcccgggcagcgctgtctcccgatccactcctcgatgcccttccgagcccaggcagcgctcacggcgaagctgtcacctgggacggggacgacatgaagcccctgagtctggctccaggtgccaaaagttacccccgcggagggaagaaggaggcgcggtgggaggcgaaggaccacggcacgggggccaggagggggttcgcgggctggggcaggagccaagagagggacgcgggtaagtaaaggggggttcagcgaagccctaggagcgaggagccagaagggggcaagaggggtgagcagtaccccaggaggacgggtttaggatcagaccagggagcactggcagccaggactgcggaggagagggctgggggtcaggagaggggccgcagtaggtgcaggagccaggatatcggaagaagggccggggggcaggaagagggggcagggtcttgcggggaggcgcttgggggtctgaagagagggtgccgtgagagccgagggcagggacgcgggagggggaggggttgagggtcagcggtgggagcgcaggaccgcggggagcgggtaggagggacagaggagggggcgcgaaggctgctcagggagcgggcttggggggccggtggccggaactggggcttcggggtggccctggtcataagacctggcgggctgggccgttctgccgcggccgcggtgtcccccgcgtccatccccgaggtctgcgccccgcgcgcccctaccttccgggctctccctgcgcttgcacacggcggctgcaggcacatcgcgaggcggcggcggcggcggcagccgcggcggcgggagaaggaaagaaaggaagggagagagttagcgaccgcggcggcgacggcggcggggcccggggcgagcgcgcgggcgggggcactgacccggcttggagtgaagtttccccatgctggggctgcggcggccgggagcgtccctaagccatgcgcccggc

SEQ ID NO: 986 - DNA, 3873 bp, Homo sapiens
gaggctaaagcgcaggggagggctagagaccttcagcgctcgccgacggcccgcccctttcgcccgctgcgattggctcaaatcctcgacctctcttttgattggcgattagggcagtcaaatttctctcggctctgggtgcgcggagagtagggcgggggattggtggggggcggggagaggagtcaaactgacgtgtgaagcgggtgagccaggcccggctgctcagtagccactttctgcacgccgtgccaactccgaggctagcctagttgggtactaggggctctgggttctcgcatttatgaagcagtgggctcctccactctgggaattcgagctgttggggagactcatgggcgagatcccccgcagccgagggcagtgaggtcagcaggtttggcagggctgagtctggccgagctgtcggaactcagccgatcccagctcgcatctggcccccaggtcagggcgtctggcgactcctccgagagcagccccggacaagcttcatccctctcccaaatgtaacatttgcttgaaactttccatgattggctactacccagacgtgaagtgttttggaaaaaatgagcaaaatcctttcagctatgcgacttaagccatgggagggtggaggtggagggagggcgacgagtggcgaggcggggtgggggggttgcggaatccagaatacgacagctttcttttttaaaaattattttttttaaatgtacaccgatacttcaaaaatagttttgaatagcaatgattccgttaacgctatttgcttgaaagcaaaactgtagatacttttctattttaaaaactgcttcactgttttaaaatagaagcgttggaatacgggttctctaagttatttcagcatcactttatccatttatccttttggacctgtggaaaaacagccaagaacctgataaactgagttattccctgaggctacatacacattacattccaggacaaaaaaatgtttttagactatttcctgaaacaattaggtttaaatggagtagatccacagagtttaataagatgttttgggggttggtgtgttgttactgtgttgttgtgtgtgttcgttttgagaaagggtctcactctgtcgcccaggctgaagtgcagtggcgcgatcacggcttactgcagccttgaactcaggggccccggtgatcctcccacctcagccagcacctgcttttttttttttttttttttgtatttttggtagagacggggtttcgccaggttgcccaggctggtttcgagggatctgcaccccctgggcctcccaaattgctgggattacaggcgtgagccaccacgcccggcctaatgaggtgatttttatgaaactagaagggtgtatgtcaggtgcatcattaattgataaccggatttagtaatctagtgaactgtaaaatatttcaatagattaataattaggaaatctggctgtacctacaggttatgtgacctttggcatgttacagccttgccgtgttttaagttttttttttctatctgctctttaaccagaagaacatggaaaaaactatcatgtgtaaaacatagtcaccttttttatttaaaaaaaaaaaagcaggacaatgggaaagtacttagatagcttttattactaatgttacttgtccaaaaatgttgatgaatcaaagtaatgatatattcaggaatagagacatcaagtttcagaggaaaggtaacaaatattacccctgcctaaccctgacttgttaatgacttgcagactttaatattgtccaatatattagctgcaattagttatcaattttaactgcctcttttttctcaacaacacaaagcaactgacaatccagttactgttttcctctcagtttctcccttaatttctctgagtttcttatgaaaattgttttagatatttaaaggtttaaaggctttatagttcacttaacaaataagaaagctaacctagtaacagattattttctagagtttctagtttctagagttttattttctggtagtttccagactttctgcttttggtgagaatggatagatattactcccaaaatttggaagaattgagtccactgaaatttaaccccttgtttgagaaggctaatgaaaaggttatagacagcaaagaaactattataaatagaataaaaatgtgactcaatactttcatttgattcttttcttcatcttatataattttttaatctttaaagatatttttatctacaactttgtaaccattacacaactttgaagtttcagttatgttaaattgaattatatcattacataaactcatgtaatcatcatgtaaaaagtataaaaacatttgtatacatacaataagtagtccaccaaaatatctacaaatagaaaaatgctctccacattaactatggttgggttgtcagatctactcttcgacttcctttttgctcctaagtgcagctacactacaaagagttgctgtcccatagccatcatcaggtaatcagccatcaaaaggaataattggaatttgtgcactttgtgtctgttctaacttgaagaaaggttcctgtgcttctatgttcctgagcttctttgttctgtcgaagattacaaaaggctaatgtttcaagatcataataaaatccatatataggccgggcgcggtggactcacacctgtaatcccagcactttgggaggctgaggcgagcagatcacaaggtcaggagattgagaccatcctggctaacacggttaaaccccatctctactaaaaatacaacgattagctgggcgtggtggcacacacctgtaatcccagctacttgggaggctgaggcaggagaatcactcaaacctgggaggccgaggttacagtgagccaagatcgcaccactgcactccagcctggcaacagagcgatactacatctcaaaaaataaaataaaataagataaaataatatatatatatagaaattccagattgcgccttcacaaaaactagtagattatttgttgacctagaactaaaaagaaagtaattttcctttgactaacagcttaaaagaattgcctaagcctttttttgaaattcttctgtttggagaatagagtaaggttcaggaagcctctaaacaagcttctgctactacttccctttcttctgttggtttcctgctttaactggccaaattcctagcctcactgataagccctgccaaacatggcttatttttccaatactgaatatagatgtgtaccaaagtaagtatggtaaatccctcatctataaaaaggggataatatggccaggcaaggtggctcacgcctgtaatcccagcactttgggaggccgaagcaggtggatcacctgaggtcaggagttcaagaccagcctggccaacatggtgaaaccccatctctactagaaattcaaaaaattagccaggcatggtggtgcatgcctgtaatcccagctactcgggaggctgaggcaggagaattgcttgaacctgggaggcagaggttgcagtgagccgagatctagccattgcactccagcctgggctatgagagagcaagactccatctcaaaaaaacaaaggggggcggataatattggtacttatagggttgttgtgtggaataaataaacaacacatataaagcacccagaataatgacagtagcactctgtaagtgttatagctgttattatcaaaccataggtgaataaattttgacatgcaatgtgatcagtttttacacttattgttgaaaagccaaacaattgttttaaaccatctaataataaaataccatttaagggg

SEQ ID NO: 987 - DNA, 1372 bp, Homo sapiens
atgctagcaattattgtacccacaattatacttatgccagtgacacgatattctaaaaattctaaaatttgaattcacacaactatgcactgcttactaattagtttcatcaaattattcctcttaagccaatttagtaaaaataacctaaacttttcattagtttttttctccaactcactatcagcctccatttcattatactaacaaattgattacttcccctaataattatagcaagttaacatcatctctccaaagaatcatatatatgaaaaagctacatatttcaatattaatctttctacatttattcttaatcataacatttactgccacagaactaaatctattttacattctctttgaagcaacactaattccaactctaattattattctctgataaggaaacaaaagagaatgattaaatccagggctctatttcctgttctacacactaattggttttttacctcaactcgtatcattaatttttatccaaaactccacatactcattacactttttaataacctgttactgtgttcaaactcagctcttgacataatagtcttttatgattagcatgcattatagcatttatggtcaaaatacccctttatagtttctatctctgactaacaaagtacacacagaaactccaattgctgaatccacagtttttgcagccataaaattagcaggctttaatataatacgaattactataattccaaacccactaatggaatatatagcttatccatttcatatagtatccccgtgatgaataattataacacactctatttgtttacaccaaatagacttaaaatcacttaatcacttatcacatattcatccataaatcatatagcactaacatttatagccattttcatccaagctcaacgaatttttataggagccataaccctaataattgcccatgccctcacctcatccatactattcttcatcacaaactcaaattatgaatgaatttatagctgaaatatgctcttcattcaaggactgcagacattactccctttaataacaacatgatgagtattagctagcctaaccaatctagccctaccaccaaccatcaacctaatcagagaactatgtgtagtcacagcaccattttcatgatttaattttaccattattattaataggacttaatatattaattatagcctaatattccctctgcatattaattacaatgcaacaaggaaaatttaccaatcacattaataaattagccatcactcacattagaaaatgctttatacatctacctctgctactcctatcacttaatgacaaaattattctaggacctacatactgtttttaa

SEQ ID NO: 988 - DNA, 2590 bp, Homo sapiens
ctttctggagtctgaaatgttaagtatggaggcaaaagctgaagctggagcaacagtctcagaatatgacaacaaccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagggggtcttgctatgttgcccaggccagtctcaaactcctgggttcaagcaatccactcgccttggcctcttaaagcactgggattacaagcgtgaaccaccatgcctggctgaagattcaagtttttaaaacatctgatttccacttgaaaccttgaattgtatcattggcaacaaataatgtcagttattttccttgagatgacaacttcacttagttattttcaagaaaactgctgccatgtagccaactgtgaatgaccacagtttgcctgtcagtcattctgtcaagtaaaatggtgctcctcaaacaaagcagcacgtttagctcacaactcaacaaccacacagcagtcttcctcccacccaccatggcacttatattaatataagcagcagaggtgctttatgtatgagtattgtgtgaaaatactcaaaagacctgtaaccaagggtcaagattactacaattaatttctactgcttcctaagggcattcttaagtgacactagcatattttacaagccagagtgtaacaatgagcacaatgactgctaccacagcttgctgccagccattgccttgacttgtcctaaaacacagccattttcatccgcctccatggctactgcatcatcagtgcaaagtcaacccagtaaaaaaggcaaatagcatctccgtgttatcataaaaatagttttgacctcatggctccccttaaagggcttggggcatcacagagagccactgctacagccaactgagagagaactctcaaaagccaggctttttctgtccctgtccttctcacagtgaaacacttaacgcactctctgattgtggctcttaactcgccaggtaaaagtccttctgtgtagtctaggaagaagggcaagggcaaagggaggactttgtttatgaagcctaagtagaatatgctctgctagataatcagtcctggaatgaaggaggggagaagtgagtttctgattgtctgagcccaggtctgatgttgggaaatgccagcattccaacccctgatttccattcccactaccagacttaggcaaagttactcacccgttcttgaccacataaatgtatgtgtgatggctaattttatgtgtcgacttgactggactaaaggatgcctggatatttctggaagagactaagatttgagtcagtagactgagtaaaaattgccctcaccaatgtgagtgatccttatccaatctgtagacggcccgaatggaacaaaaaggtagagaaagggagaattcactctctctaacccggaacagccattcagccattttctccttcccttggacatcagcacttctgattctctggcctccagattatgactgtgacttacaccatcggcctctctggatctcaggccttccagtttggactggaattacaccaccagctttcctgggccttcagcttgcaaacaggtgattgtgggactcttcagcctccataatcacacgagccaatccctcataataaacctttcctggccaggcgtggtggctcatgcctgtaatcccaacactttgggaggccaaggcagccagattacttgaggacaggagttggagaccagcctggccaacatggtgaaaccctgtccctactaaaaatataaaaattagcgaggcatggtggtgggcacctgtggtcacagccactgaagaggctgaggcaggagaattgtttgaacctgagaggcggaggttgcactgaactgagatcatcccactgcactccagcttgggcaacagagcgagactctgtctcaaaaaaaaaaaaaaaagaaacttttttttcatatctctatatgtgccattggttctgtttctctggagatccctggctaatacactatataacaattactccctttgaaaatcaggaactcacagatgattcaaagtgtgacctacacttttcttgctgatgcctggccataggcagcagcgcaagactgtgtctctctctcaatctctctctttcacatctcaggtttctatgcagttagaaaagctacttttctagaatcactttttcctaagtaatccatatcacatctgttaggaattactaattaataagcaaagttaaccaaaaaaagagagtattataaatccatctttctattagattgtgataactgcccccttctattcattatttcctgtaccaaactcattttgtaaactaagatcaagtctaataaaaaaattcttttttgttaagtagcaa

SEQ ID NO: 989 - DNA, 1789 bp, Homo sapiens
acccattatacccactgcagtgccagcacacagtggttggataactgcatacctctgagatgcatgaaaagcccaccccttcttgctgggactatctgagatagtgagtgtaacttgaagaaatggtacctagcctttgtccaggcttaggatttgaaaaaacaaataaacataaaatagaagactccttttttactttccttcttatctttaaatcttaacctaaaatcttttttttaatttttaatttttgtgggtacatagtaggtgtatatattttgggggtacatgagatgttttgatacaggcatgcaatgtgtaataatcacaccatggagaatggggtatccatcccctcaagcatttatacttcacattacaatctaattatactcttttagttattttaaaatgtataattaagttattactgactgtagtcacactgttgtgctatcaaatagtaggttttacttctttctgtttttaatacttattaatcatccccacctttaccccatacccccactacacttcccagcctctagtaaccattcttttactctctatctccatgaatataattgttttgatttttctaagaggacatgataagtgtttagtttctttgccaatcagtatccccgtaattttggaaatgatgattctggaggctgggcatgtcatttttgactgaccatctggttcacttactggtgccatgaaaaatctgcatcatcttaccgcatcattgactacaaggagaatgtgtcaggtctagatgtgttttagcatgaccatcaacactgctaggactctggcatagttgaatgaacaatgcatccagatactagatgtgggaagtccagacttggttctgacgtgtgggacaagtcagctgactcttccaagccaccaagtccacttgtgctaaatggtggcatcatcagattcagtgagctattccttcctttgtccttgtatgaaagttgagatttactttttatcagttatttaaagatctaaattacacagcaatgacaaatgtgcttctatgttcaacttcaacctttggaattaactagctttccaggtcttactttgttaaacttaggtcatgatccacaatgttctctccaggttgatctgttcaagtcttggacagattttggtatagctcttctaggttcctccagacaccccttcccatttccacagtccctggaatcagtttcagtatacatccttcactagacagcaggaccacagcctacaggctctggagtcatcttgtcctgggggtgagttctggctctatcccttgttagctgtgtgatttcatggagatttccaaatctccctggaatgcagttacctcctctgtagaataaaactaatcccagctatccgtcagagttgcaatgaggctaaatgaattcataggcacaatgaatttgcccagctaatgctgatctactcctacttgttccttcattctcccaaatgccctctcttctccctcctgactcatcttgcttgctaagtcatccactgtttatttcttgtgcctccctggaagaaagatgacatctgcttcttgtctgtaagcctctgttgtgatttcttcactcttctctacccacaagtatttcctttctggactcaccaacttccttaggctgggatgcaccaaccttcacattctttgaagaagagcctgtggggactccatcccagtgctttgagcagcctatccctccttgctcagtctctacaattgcatgctagc

SEQ ID NO: 990 - DNA, 6262 bp, Homo sapiens
agttgccgctaggcgaaagtggggaccgccacacagttggctgcggattaaaggaaaatcaatgtgacgttaagcaagacatttattgtgcccacagcttcaccattctggtctctatgattccctgcgaagattgctgttatcccccagagacacagctgagctgtctctctaaagggcctgtgttctactcctgaatctggtttcccctaagcttttatctcaccctggtgacagctcagaaacacacaaactctgtgttaagaaaactaagaagtcattcatctgcacatttcccgaaatcccccagaagcccgtattagactgaatggtgtccttattgcaaactctccactttagccaaggtgcaaagtcctcccagtcccccaggagcttcccttctctgagcggtacttaagttttctgtaaaaccactcagttcaacaaatgagcttctcaatcttagtttctgcttgttgactttaaagttaatctataataaacacactgcagtcctcttccctgactcattgtccactttgtccatttgtgtcctcataccagattgtctcaattctcttaactggtgagatattatgaactcaaagcattttgcacaatgatattccaacatgctgcatgcaacaagcagacaataagtaactagtgagggaaatattccctcatactcaagagaaccctttatacatttttaaatattttagggccaggcttatgcctgtaatcccaagtactcgggaggctgagatgggaggatcacaggagcccaggagttcaaggctgcagtgagctatgatgatgacagtgcacttcagtctgggtgacagagtaagactgtctctaaaagtaaaatatcttaatactgtacctgacatctgactagatgtacccagcaaccactatgtgccataatctctggataaattctatgaacattcacttagaaatagctgcaagtccctgaagacagtatgacaaatactgaggcccacagtttttgggtgatcagttgcataaaatgctaaaatagatggttcctgttttgaatgtcactttcaaacatagaaaaaaaaggaattctgctgaaaaatcatgaatggaaaaaaatgttcatatttgttgaagctggatcatgcatagagtttattactatttgtgtttccacaataggctggatgtggtggctcacgcctgtaatcccagcacttttggaggccaaggtgagcagatcacctgaggtcaggagtttgagaccagcctgaccaacatggagaaaccccatctctactaaaaatacaaaattagccgggtgtggtggcaaatgtttgtaatcctagctactcgggaggctgaggcaggagaattgcttgaacccaggaggcggggaggctgaggcaggagaattgcttgaacccaggaggcggagcttgcagtgagcagacattgtgcgccattgcattccagcctgggcaacaagaatgaaactccgcctcaaaaaaaaaaaaatccaccatcaagttattaaaaacatataaatatatgggagaattccaaaatcaccccttcccatgacccatatggagggacctacaaacatgaaaggatattaccagtgattaggttactttacctggcagttaacttgaagggagattaccctcattgggcctaacctaatcaggtgagtccttaaaagagttggggctctacctggaggagactggaagtgtgagagggatttcacatgagggagtttttctgtttctggctttggcgatggaggggaccccatggcaaggaatgctggcatcctctgagcactgagagtggctcagccaacaaagaaatagggacctctgtcctacaactgaaaataactgaattccaccacaaccctgaaagcctggaagaggacgccaagcccccagataaaatgagaagacagcctggtcgacaccctaattccagcattgtgagaagctaagcacagtccaggtaggcatgcacacctgcctcgctttgacctgcagaactgtgaaataaatgagtgttgttttaagctgctaaacatatggtaatctgttgtacagtgagtgaaaacgaataatatataatacacagagcatgaagacaaaataaatctaaacaaatgccctgtttatttatattttattaataaagacaacagaagaaggatgaggtttcaatattttattcaagttttttaagtgttgttaattacagcatttgaaggggaggatctaattccaacaaaatggaagactctaaaatgtacccattaaactgctaaaaaacaaattgagtggtgagaatacaacagaagtccaatttagattctgagtgttgtcaccatgtgattacaatcacacagacacttccaagcttatagctggagctcctggaagctatttcatactctggtgcaagggccaaaaaaaaacacaacacaagaaggaataagtcctgaattattggcttcatcacatccaccttctccaccccaaaatggcacaaaagaaacagttaccacaccctgcagaccttttggtgtaaaagagatgatgatgaactggggtgggaacaggtcatgaagatctgtctaaaaaagtcccattcaggtgagtttgtacacaccatcaagcagcgagcctctcatcaattagggttagggaaccaaggttcgattctcaggaaatcacaatttcattcatttactcaatatgaatttacaaagtgcctacatattatccgcttccacttgcagccatttctagataaaaaagaaacctggcatctcaaaggggccaccaagttctccccgagtctaccactgaaaggaccttttttggaaataggtttcttctgtacctctggaagggtaacatcttaaagctgaatcaactttaacctggagggctaacatatttagcaatacttgcatcccagacatacaacattaaaagatacactaaattctgaaggtagctatgctgcaaaatagtttaaaattaaacaattgtacagtattcatttatgcttgaaattccagtcctagaccaagcttgtggccaccagcattgacgttcttgccatccagaagagctgacagtgtcagtttaatacctggctttagagtctgagtgtatcctaaacctatcaggctggagttgttcactttagcctaatcaaggaaatgacaaaacagagaaaacattaagtataatactttgcacttccatctccaaaattagagctttttagtcaaccaaccttggactttagaatcaaaatttttcatgaccaccttgttcatgagattcattaaattcaatacaaaatacatcaattttaggtgcatacctttctgttcaaagggtgtgctgagatctgacacccctcataagaacaaagcagagagaaggaaggcctcttaggggccagtgtccttttgctcatataaataatgaggctccttttctcttgtttttaagtgcttgctgttaagggagccaaattcggttctagtttaggagacttaaaaagggctgtccataaattacacaaaccagtacagacaccattctgcaacatgagattccctcatttcaccccaaagagatacagccgccagtgccctgtgacaacagaaatgagcccaataggatttactgcaaaaactgtgtagtagttcgagggcctgtgagcaatgccagagactctgcaagatgccaactgactattgatttcttaatatgcaatgcaggagctgaaaaggagaatgaaaagtgaggcggggcggggggaattatcaattagaaccctagatttcagagtgccccttttaacagtccgcatgatagaacaggaactggtattaatggaagaggcttaacagtaagccagtctggttcaaatccagctcccagcactttcctgctgtgtacctttgagcaagttactcacctaagtttctagttcctcatttgtaaaaacagagatgattggccaggggccatggctcatgcctgtaattccagcattttgggaggccgaggcaggcagatcacctgaggtcaggagttcgagaccagcctgaccaacatggtgaaaccccgtctatactaaaaacacaaaaattatccaggtgtggtggtgggtgcctgtgttcccagctacatgggagggtgaggcagtagaatcacttgaacctgggggacggaggttgcgcagtgagctgagatcgtgccattgcactccagcctgggcaacaaagggagactccgtctcaaaaaaaaaaacaaacaaacagagatgattggccaggcatggtggctcatgccttgtaatcccaacatttgggaggttgaggtgggaggacagcttgagcccaggagtttgagaccagcccaggcaacagagtgagacattgtctctactaaaaatttttttttaattagccaggcatgctggtgtgcctatagtcccagctacttgggaggctgaggtggcaggattacttgagcacaggaggatgaggctgcagtgagctgcaattacaccactgcatccaacctgggccttgtctcaaaaaaacaaaaaataaaaaaaacccagagatgattaaaaaaccaaagcacctatttcaaatgggattaaacacagtaatctacacaaaaggctctgcacagtgcctggtacccataagaagtactagtagtatgatcactgtactcatttggcactcttttcaaagtgagaacatctctcactttgtttttgtttttttgagacggagtcttttttttttttttgagatagaatctcactctgtcacccaggctggagtgcagtgacacgatctcagctcactgcaacctccgcctccccggttcaagcaattctcctgcctcagcctctcgagtagctgggattacaggcacacgccaccatgcccggctaatttttgtacttttagtagacagggtttcaccgtgttggcgaggctggtgtcagactcctgacctcaagtgatctgcctgccttggcctcccaaagtgcagggattacaggcgtgagtcacggcgcccagcagcatctctcactttgagtaagctgaagcacagcactccagcaaacctgaaggattccaacataaagagcagatgggcctgcctgtgagatgcgtgattccacagatacccaccgagaagcaggcgtcagggtcaatctgatacttggctgctattccgaagcgcgtgttactgtttcctgctgtccaggcaagattgacagcggtctccaacttcttgttcactttctggtaaatggagccgccaaactctgtcccgtcattcctgcaaacaagcacaggacagatgctgagcttcccagggaggtgagctgcagcccagacagatccacccaagtctcccagaagacagggatgacagaaatggactgaaccaatactggtattaagggaagtcagaagttcaccaaatttcacaaaacaggtactaaattacaggaagtctgataagtatggaacaggcacctagccaggcacagtggctcacacctgtaatcccagcactttgggaggccgagatgggcagatcacttgaggtcaggggtttgagaccagcctggccaacatggtgaaaccctgtttctactaaaaatacaaaaattgaccgggctggtgccatacgcctgtaatcccagctactcaagaggctgaggcaggagaatcgcttgaacctgggaggcagaggttgcagtaagccgagatcgcgccactgcactccagcctgggcaacagagcaagacattgtctcaaacaaaaaaagaaaaagccaggggagagggggtacgtggtgactcacgcctgtaatcctagcattttgggaggccgaggcagcaggactgcttgagcccaggatatagcttgggcaacagagcgagatcctgtctctataaggaaaaaaaaaaaaaagaagcagcaagtagagcactgagattctgagtgatttatttttactgctactgatgttattacttttataaacgattctaccagaaaaatggcatggaagtccgggtgcagtggttcatgcctataatcccagcactttgggaggccaaggcgggcagatcatttgaggtcaggagtttgagaccagcctggctaacatgatgaaaccctgtctctactaaaaac

SEQ ID NO: 991 - DNA, 4518 bp, Homo sapiens
aggagagcatggaacacaaccctcatttgcatcccacaccctagaatctgcaaggacatgacagactggaaaatatgctttcacaaacccaccagaagtgaagcttaggcagcaaagcccgcagcttccgggacagtcacatgagcctgagcccagatcgcagcacatccagagaccagagccaggccttggagttctgtgacagccactgcaaatgactgtgggcaccgcaggtctccaccagccctgtgccaagccggtgaggatgccctgccatcttcaaggctcactgaggcggcgggctctgggtgccctctggctgctgctggagccccctgcagagcccagatcattgcccacagagagcttctcattaagagctttcagtttataatttcttggttcctagaattttgtagagacttagattgacaggattctggcatgaagttaatccgcatctgcaacaggctccaaacacgacccacatcccggccccaggcatggggctagggcccaactgagctgggcaagatcagttattcgttgtcttcagaattcatgtttgtaaaatgcgggacccatgtcttggaggggtgacaggagcagtgtttagagcatagcacagggcccgtgcccatcaggcgttattgctgtgagctgcctttattcgtgctcaagttatcgaatgtgaacaagtttagtgtcaaaaacaagaagtccaacaccgtgatgcaggattcatcgaatgtgggcgtccctgccacctctccactggcccctgtgacagtcgatgcctgatgtcacctgtcagttcaatgtgtaaaagcacaaaagtagattcctgaattgtgtcaatgccacagaacggaaggggatggtgctgcaggttattcctgtgtttctaggaaggcaacaactggatagaatcgggcagaatggattttgtctagtgtttgatggaaataataaccccacatggcttgtcatacacacaaaatgcagagaaatatgcagcgttctggagtgtcctgcacgctgtcacatgggacccccatccactcttcctatcaaaaggctgatggatcatggtctctgcagatgcaggaactgagctcagagagaggccgtgtcttctccaagacccccagccaatgagagggacccaggcctgagcacaggtttctgaatcagagtcctgcctctcaccttctcaaacgtccttgcttcccttcccaccaagttttaattgagtgcaccaggattgcggtcttccaaaggcatttatgtgattgccttttcctcttcgatttctcaccagttagcttataaatgacaaagtctgccccgtggagagagcgttctttagattttaatagaaagacatcaacatcgccatgaaaagatgaagacaatgaaaataattatttagtaggataataaacggaatctgggcagagtcgtgctgagcagctatgacttgcatcagcgcatcatggactggcagcaactcactgcgcagaatgtccgggccacaggcttgggctcccccgacaccccgtttcccatgggcattttccctactggggactaacatcagatgggttcacactcgtgaaagacgctcggcaccaagaaacaggtgcctgcagggctggtgcgacacagggactctgtggtgtagtatgtgtggctggtcggtgtattagcgaggatggggacacgggtgtccagtaaggagtgcttgaacgaaggtccttgattcacaaaacaggaacagtgctgaccgcccgccctcctttatcccaggaagaactccaactgacatagttacaaacagcatggaatccaaaccttaccctcatcacaccgtaaataacatctttgtacagcactttatgatttttaagtcaccttggcatataaacatacatttcttttacataaacacatgtgcatatgaagaggatatgtgtgtgtgttcacaaaagtcacgtctatatataggacatggggctggttttggtaaagccccttggagaagggcctaggtgggagtcctggctcaacccccaggtcagctacttgtcttcgggtctgaccctgaagccagcttcccacatccccaccctaaattgtatcagggatcctgagaagactaaggcagtatggggctctcccagcagggaacctgttcctaattcagagctttgcacccagggcctttgggcgtctgtgtgcctgctgtggatgggagaccctgcccctgcatcttccacggagagggtacgtagctttcggcagaccacaagacgctggaagtgaaggacacccctcctttatttactctgaaagttctgtttgcctcactagaattctgcatcataagaactcccggacttgtatggccccactgtgatggctggatctcagctccccacagcccctctgaggcagccagggcaggtgtccttatcccctttgtatctgactcctccaacaaccctcagggtcaatgatccactagaaggattcacagaaccttaccatttattacagaaaaggacatagattaaaatccgcaaagggaaaacgtacttgggacagagtctaggagagaccagctgtgagctgcccactgtcctgtcctgagggagccacgaatgcacttcattctcacagcaacgactgtgccagtgtgcacacagcaccacctgccaggggagcccccgagccttgggatccagggcttctcctgggagcgggtcacataggcctgcatcatcccgctggctaatcctagtcacccagtccagctatcccagaggtcacactgatgtagcgtggctctaggctgcacacaaatcactgttaacatgaactccatgaactcttggccatggatggaggtcgctggtaaacaaagacactcttatcaagcaagataatccaagggctcaaagggtatcctctgggaaggacagggccagaccttcctctgaacgtgcagggtttggacaccccaagcctgctgagtcaaccctttactgcacgtccttgtgcaaatgagaaggcgcaccaggaagtgtaatcgctttcccaagtaacacagttcttgaggccagtaaacaataaggccacagatactcccaatgcatatttaggaagggtgcagtgtaggatgccttgaggttttccatgagcattgctgaatactcttaaaatccagagacctgtgtcagccggggtattgtttcccgaggctagatataaggctgacatagtcaaacttgctggctacctctcaacacagcctgggcccaggtgcgcacggtcctaaaacaaagaagtacgagctactcttttgtagtagaggaggcttctaagaaagtaaaatataaatgactgtattggcattttcagcatctgttgtgaatctagtagttcccacaatgggagaccaccacacacctgtgcagggcagggccgatgcttcacacctggagaactgaaccaggtgccagtgggaactgggcggacagggacggcagcctcactggggctttagaatccagagaagcccatcaggccaagggaagggagtcccagtccccaggcctcatgtggggctgtggtcaaggcacaccctggagctcaagggtgaagggtacagactttgggatgggaagtgtctggctttcaatccctcctactccacccccaagctgcacagccctgtgccatggcttcccctctttagccacagctttcatctctaaaatgagtgtaataataataataatacctgtgtcgtttttctgagaaataaatgaagtagactgcatgccaatgtggaagacagccgtgctgggagggtcgtctgccttcagtcagccctacgcggccccttggacccaggcctcagcagcgtaagaccaaggccctgagtgctcacaggagatggtccagccagcctcaggcctgttgggcagctgcccaggctcagacagggcatagctgctcgggcagtgaggacaggtggttggagcttttctccagacacaggtgcagtgaaggcctgggttactatgaagcatctaccgaggggcaggtctcagggcctccaggacctgagctcttccctggtgcgggccctggagctggtgtccatcgaagactacggggcacacgccctgggaggtggagaattagccccgctccgtcatgctcctgtgtgtgtggtgcgtgtgacttccttttaaagagaagagtgtgcggaggggaagcttggcgggcatgacctccaccaggtggacaaggtcagcatggtcagtgacaagtcacatcgacagcactgcccttgactgcctgtgacaggcatagagctcatctttggggtcctcctccccgaaacccacagccccagtccgatcttgagaaaaaacatcagacaaaaccctcctccaaacagccaaggtcattagaaaccaggaacgtctgagaaacggtcacagccta

SEQ ID NO: 992 - DNA, 3485 bp, Homo sapiens
acttagatatgcagctgaaggggttcctgggtttatttctcctgagaactggcatgggctctgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctgcctccttgcctccctgcctccctccctcccatggggaggccagaatctggctgcttgctgccacctagtggctctttggggtcatcttccctcataggaaccacagatccagtagcctagagcagaaagggaaggaagattcaacctaggggtgtttatgtttaccgtgtgtctggcactcgtggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccggcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtttgtgtaaggctctcctgcccccacccccaggcaccagcacagcctttgccttcactctctcccctcccctgtccctgggggattgaataagggaagctggggttggccgtccttctagcttgattggcagcaccagcgctgtgacggaaggatgtgttgtgccagcagcctcttggccgcaggacaaatgcacatttaaagagataacctttttgtgtcctggctgggaaagaggtcagtgcagatgtttttgggtccaggtgttggctgtgagttttcctttcctctatgaactgacctcagcagcctagtggacagtcacctccttacaggtgtaaaatccaagccagtcaaccatagcaggtggcagacttagctgccttccctgtggtgtggtgcagaccatgacccttgaggcaaatgggtgagctggccccacctcgcctgcagcctcctctgaggctcccctgctgcctccccactagccgccctgaatcacctacttcccagcacccccagcccgtggttctcatcccgtcttccatctgtgatctggcactcattcttccagagccaaagaggaatcccctcttctcatgcagaagacagtcatgcctgcccttgtgtgtcaaaagcattgcatttatgccctgttagaacccctgtcacaagcatggtgcctgaacacaggtgcctctgtggtctcttctcatcctcacccaatgggtactatgctagccccattttacagatgaggcaaacgtggcacggagagctccactaacttgcctggatgattcatgcatccatccattcacttagcaaatacttatttaacttctgctttgtgctagctagtggggatgtggcagtggggatgtggcagtggggatgtggcatggggatgtggcagtgaggaagacgacagacaggctccttgggaagcagagtaagcaagtgaggagacaggcgggcgtggtgaggctgcgcaggcgctgagatcgagttgctgggggaggcctctctgaggtggtggggcttgagttgattctgaaggacaagaagagccagccctgggggtctgggggaatggtattccaagtggagggaacagcaggtgctgggggcagggaggtgacagatgtgtcccaggtacagagaacagagtgaacaggagagaggagggggccagggcattccaggtggggaaaggcagcaggtggcccggtggtaccacctcttttggcgagggctttggaccttacccggtgtgatgggaagtcctggaagtgtgttaagcaggggagtctttttgatcagattttctagaaaacgacagtgggctgctgtggacctcagagaggcatgtgtgatagtgtgtttcgggctcttcccacgaaactcggctctgcacagtgagacctcatttcctggttctgtttgatgagtgagcgaatgcacatggcaggcggtcatgtcccttgggcctgtgaggtgaggaagggtccctgagccctgtggggatagagactcttccaccattctgacatgatccgagttagcaggcagcactgtccagatggaaatggggatgggagacagaccatctctctcagcgggtccagccatgagccagcagactgtttcccattggcccccatctttcagagtgggatgatctttctaacaaagaaacccacacaggaatttggtgtgtgtgtgcgtgtgtgtattacctttcaggatggaagccggtggggtgtggagcgaggggctggcatggttggcctcgcccagctcctgtaccctgtgtgtgcctagagcatgcacctgctccctctgctgggctgagactcagaggacactgggcaggtggtggggggtaggagggtcgtggctgtgttgggtggggccacatcaggtgtgtggcacagagggggagggggagggggagtggcagtgtgttccacccagcagtccctgtgtttgacctcttcgtacactctctgttgtattagctctcagaatgaaaacgagatacttttccccaatctatgtacgttgttcttaagaatgtacacttggccaggtgcagtggctcacgcctgtaatcccagcactttgggaggccaatgtgggtggatcacctgaggtcaggagttcaagaccagcctggccaacatggcgaaaccccatctctactaaaaatacaaaaatcacctgggtgtggtggtgggcacctgtaatcccagctactagggagactgaggcaggagaattgcttgaacccaggaggtggaggttgcagtgagccgagaccgcgccactgcactccagcctgggcaacaagaacgaaactctgtctcccaaag

SEQ ID NO: 993 - DNA, 1967 bp, Homo sapiens
tgtcctggctgcgtttctggggcccgtggcccctccttacgtggcagctattgtgtctcctagtggcaattattgtgtctactagtcaaggaggctccacatctggtgttggtcaaggacccgctccagctgacctctaacccctggggtcacctgagccctggtcttcccgctcctcccatctcccatgggaatctcctcatgcacctgctcccccagcagccccaggggactttgattacctggggccctctgcttcctcacaggtgtcagccctgccccaggaatcaaatgaaaatttggttccattcctggatacggattcaggtggagagctgcccctggggccagagcagttcttggctgcacatcaggatttaaatgacaagcggactccacaagaaaggctcccagaggtggttccactgctggacagggatcagaaccagaccctagttcagcttcctcgcctcaaaagtaagtttcaaactgcagatctagatcgggctgcaggtcatcaggcagatgaaatacttgttccgctagacagtaaggtttcaaaaccaaccaaatttgttgtttttccaaagaacttgaagaaagatctagctgagcgttggagccttgctaagattgtcgggattccacaccaattatacaaacctcagcgtcagaaacagactttgcagatgaatatttgagtatggacacactgtattccggcagcctgcctccagaactccgggtgaatgcagatgagcctccagggcctcctgagcaagttggactttctcaattccatctagagcctgaaactcaaaatccagagacccttgaagacatccagtcctcttcactccaggaagaaaccccagcacagcttccactgctccctcaggaggtagaaccttcaacccagcaggaggccccagctctgcctccagagtcctctatggagagtctagctcaaactccactgaatcatgaagtgacagttcaacctccaggttgctcattacaactttcccaacgttacagtcaaacctgcagatgtggaagttaccatgacttcagagcccaaaaatgagacagaatcttcccaagcccagcaggaggccccaattcagcctccagaggaggttgaatcttctacagccctgacgactacagctcctcctccagaacaccctgaggtgttcaccttcagacaagggtcaggctcagctttcacacctgaccgaagccacagttcaacctctggacctggagcttagcataactacagagcctactacagaggttaaaccatctccaaccacggaggaaacctcagctcagcctctagacccggggcttgccataactccagaacctactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaggcaccaacatatgtgagctctgcacctgcggagatgagactctgtcatgtgttggtctcagcccaaagcagaggctccgccaagtgcctgtgccagagccctacacctacaatggcatcttcaccaccttaaatttccaaggaaactatatttcatacattgatggaaatgtatggaaagcatacagttggaccgagaaactaattctcagtgaaaattatttgactgaattacctaaggattcatttgaaggcctgctatccctccagtatttgcaataaaatacggtatattgaaagacaaacatttgaatcactaccatttttgcagtatacaaatctgggctgcaatttaattacagaactgagccttggaacatttcaggcctggcacggaatgcagtttttacacaact

SEQ ID NO: 994 - DNA, 1712 bp, Homo sapiens
taattctcctctttgcttttatctcctgacccactgagacaaatcagctcattaagcagtgattcccggagctcagacagcagggagagtgcctggaaagatggggcaagaatgcggagcagcttctcagccccttggagctgacaactttccctcaaatgtcctgtaagaaggcctccttaggagtggaccactagatggcttggaaggggccccaataggttggagcacccctgggtcggaaagaggagttcatgttcaagtcttctcccatcacttactgccaggcccaggatagatgaatgctgatgttcagaataggcaactgtccttttctgggactggtctccttctgggcccaattctccatggggcctctggggctaattacattgccgctagatcagatcattttcaaggctctggtggacacctctttctgacagttgaagggacagctggtatagcccagggtgccaaggtgagcttgaaaacaaacctctctgtggggctggatggccctaggaggttcttcccatccctggtgagaaggcaagggctattgcaaggagcagactgacatgtggatggtgttggagggcagcctgctgacccattgctccctcccatctctctctggctctgatcaccctcccccacttccctttctcttgcctggctccttgctctccctgaggccccctctgaagcagtaggagggagatcaggctctaaataaatccaacggctcatctccctcctctccttcccccgtgccaggcaagagaggagctgcagcctgcccacacactcactaggcaaggggggcaccaccagggcactgtgccaactcctggcagctccaaagtactgaaactctggctattttggcgtagcagggtacaggaaaggtaagaccctagatcatgcttggcagggcagccctggcctccccaagtaatactggagcactagagatgagtgagcctggaggacttgggagtaatggagagggggttccattctgagcacaactcattaaatatttaggaagagatcctgtgattcccatcccagggtgagaggtcaggtaagccagatgcctcaggcgttatgattactaaattaggccgccagcggtgcctcacacctgtaatcccagcactttgggtggccgaggtagatcacttgaggtcaggagttggagaccagcctggccaatatggtgaaaccctgtgtctactaaaaatataaaaattagcccagcatggtggcacatgcctgtagtcccaactactcaggaggctggggcagtagaattgcttgaacccgggaggcagaggttgcagtgagccgacatcgcaccattacattccagcctgggcatcacagtgaaactccatctcaaaaaaaaaaaaaaaattactaaattaaaccaggcatagagactcatgcctataatcccaatgctttgggaggctaaggtaggaagatggcttaagcccaggagtttgagaccagcctaggcaacatagcaagatcctgtctctacaaaaaactagtaggcatggtagcgcatgcctgtagtcgtagctactcaggagacaggaggatcgcttgagcccaggagttcaagcctgcagtgagctacgattgtgccactacactccagcctgggtgacagagcaagacctgtctctaagtaaataaat

SEQ ID NO: 995 - DNA, 1292 bp, Homo sapiens
ccacactgtgaccttctgttactattacaacagatggttcccagtgagcacaaggtgatatacttcctctgtccacgtgggcccaggtaaccagtccagaccccacaccttgttcccattttaaggatgagcaaactgaggctctgaaaagccccacaccagcatgcagcgtggaccaaaggcacaggaggcaggagccagagcctctcggcaggtggtgcacagtgggaagaattcagagctctccatggcccacctctatgttttgccttgtaaatgatgatgacatcttctctaaagactttccctcttgggagaatatcgtcaatgctgacactgacatgaatttgtctgatggtgagggcggtaggggcacacagccaagttcctggagagcaggggcagcacaggacacatctctctacccacagcgctcaccacagaggctctgccacattcataaggagggagagaagaggggatgggccaatcctttgcccaagatcaagtctttagggctcaggttcattcggaagttagggtaagaggtgaacttcagaccagtactcgattggagactagaaatgagaatagggtttaagattcatattaaggaagggatgatgattcgagctgtacttcagattgatatggattcaagtctagattctggtgagagttctgtttaaggtggactctagggactaggttattgttagccctaaggctcaagctaaaatgcatcttagcattaggtgtgtctgaaaatcctggggcttgcagcaaggttcagtgctgtgggctggggcagaagctctgcaggtgacaggcctgacagccagctggagaggtaggtgtggccaggcagccagggccagataggctctgaggccagcaccgtggacagctccaagggaagcaccttagtaagccaagaagccactgagatgttcccagctgccaacactgaccccgggaagaccaagatggcaccatatcctccagggagttgggggtcttggccagacaatctcctctttcccttcaatattgccagatgccatgtcacaagaagaggtgctacggagcagcgacaggctgaaggaaatcagatactgcccacactcagccccatgtcctgcaggtcatagataggcaggacttccaaagcataccaacccagcccctcagaataggggacaaggtcaccaatgtgaactgaccacctactttgtgccagacctagtcaacattatctcattgcatcataaaaccagcccgagtgtagtagg

SEQ ID NO: 996 - DNA, 2378 bp, Homo sapiens
caagtacttatttttcttgtccataatctgtgaatcctgctgaaatcagctagactttgctccaggatgagggattggtccaattctgttccatctttccacgcatctttcatcaggttattaggaaagagtacacttcactggctgctctactgggaggctttatctccattaagtgaaccacagagaaaaaagaagagaagagttttacttctgtcatctggtgatacattgctttggtgaatacaagaaaccacaggataagcaacagggctctttggtaaattccacaggctctcctgatagggcagccaagtcttttcccagtagccagccctttgcactaaaacatgtggattttatttctatggatgttgtgagtgtggacctaaacttctctaagagaacttgtatttctcaagcctaaagatgtattacatttttttgtatttgtatttgatccacataaagaaggggaaaaaaatttgtgtgtgtggatagcattccaagaaggaactctagccccaggaaagctgctatttctgctcttctccagctacctgccaacaatttgtcctcaaaagaggctctttctgactatttacagatctgtcacttacagattggcaattttcatgcatttcattctgctttgctttacttcatactggcatcatctttatcagaaggatatataaatatagatatatggatatcgtttgtcttccctttctccacattaacatattccatgagtgcaggaagtgaaatggcatctttatttcattactctctggtccataatacattccctggcacaaagggaacacttaaatacttaactatcaaaataaaaaaataaataaaatcactggatatggaacatgctcattattaaatgtttttctagcactctaccagaaaactatcagccactgttccaccacggtgctttccctctcttgcttcttgcacctcctctgatgttcttcctttttgttagttccagttccacatcacagtcacgcaaatgtaagagaatggagaatgcagtcctttctcagctgggcacaaagtaatgctgagtgaaacagaagttgttattgtggaagaggtaggtgcctgaactgggtgtctcctgataacctttctccccattgctctgtgtcccatattcagagtagactcaccaaagttctcctttgctttctagcttccagtcgattttgaaaaattcagagcatgggcaagacatagcagaaaaagaaattgtgattgattggagtatttattttcctggcttcctccatgtggagttgctaaagaccggctgcatctttcagctgcaatcacagctcctgcctggcagccttctcggtctccaggaccccgtatctgaccagtttccaactcatcttcacttgggagttggctgtgaagagacaggcaagtctcttcatcaagcaggaggaaaacatacagcgggaaggaaatatgaaacgacctcatttctagtttaaccctttggatctcctttgtaccacgtctccttggatgagaagagtctccctctcatcagcacattaaggaatctaccatacaacttcagtcttcagtattgccaaagactagtaacctatgctccaagagttaatgactataagtgcatcactgaagcctgtagaaaaaggccctgatgcctcctgccctaataatttgtatgtgtttatttttttccatttgcaagatagaaaacaaactggtctggttacaactaaccatagatttgcaccaactattagaaatggatttttttatcatcagttttttttcatgttgtgttcatgctcatccctcagatatttatgtttcagtcttgggtaatttatttctatttactttaaatttccttatgaaatagtttcaattatatcacaggttgttataaatagttggtgttaaattatatagaggtattacattgctacttaatgcctgcatttgatgtggttattacaatggtgacgctatagatcaccgtagcaacaaaaacaagaattcatagcctgtttcaaacataagaggctgaaaatatttcatagttattgaaagctgaggtatgaagcaatttaaacatttagctgctgagtaattgggatctagaaatacatcaacctagatactgaatttttagaagagtcaatattgaataatagcacaggtcatttacttttaattgtctagccatctgaatgcttgagcatgtgaacagtaacttcacccatgtagcttatttatctatgtttcataaacaggctaccttctgagagttaattgtgtgaacaggaaaagtcactacctaataaattgatgttcac

SEQ ID NO: 997 - DNA, 1037 bp, Homo sapiens
ctgtagtccaggttggagtgcagtggcgtgatctcagctcactggaacctccgcctcctcaattctcctgcctcagcctcccgagtagctgggattacaggcgtccaccaccacatcaagctaatttttgtatttttagtagagacggaatttcaccatgttggccagactggtctcgagctcctgacctcaagtgatgtaccctccttggcctcccaaagtgctgggattacaggcatgagccaccgtgctggccagaactttgctttaattgttatttaaaactagcaaacattgctttttcttccaataacatttccttctttctttactctgaaaccctgtgattcaggtttagccagttagacaaccccattcctttggccaaaagtgattagttcaggaatgggaaaccatccaagttggaccaattagagtaaatcctgtggcttctgtaaaaacaactgagaaaatctactcttgttttcctgctcaacttgagtttggagagatgaagacctgggttcctagcaagtcatactgccacctcatggagcctgaaaacaaaatcaaagtgaaagaaagtacagctgagagctggagaaatgccaggttctgttgagatcacttgatgccttgaatctacctgtgtatcccttatcctggaaggtagtcaatacattctgttttgctgaagacaactaaagctgtgtttgtaatcatgtacaactgacaaattccagaatatacattaagcataaatgtgacgtccaagatatatccatctaggcctactttataaagaatattttaaaatttaggaatgatattaaattttatcaaatgtttcttttggcttctttagagattactgtttatttttattttcccccattaatataaaagttgtgctatagacttcccaatattttgttcttgaagttttgttcactgctgtttccctagtattatacatatatagtagcatatatagtaggccctcaataaaatattcagtgaatgaattaactgctgta

SEQ ID NO: 998 - DNA, 1132 bp, Homo sapiens
cgacagatatgcagctacacaatgtttttactatcttgagttctttttacccagattccatagctaaatccagatgtattaataggtagagactacttcagaaaggatgagactattttcttgcttaattatccacacagtaattcagaaatgtatattgaacactttttatatgccaggcactgctgggcactggaaatataaaagtaagcaaaaatgaaaaactatcctgtcctcctgaggcttagcatctaagggagacaggcattagtcaaccccgtgtggctgtgaatcagccatgatgctgagtgctacaagagaggactgtgcggctgggagggcttataacaggatttgacctagttagggaagatctgaggaagtgatgaaagaatggaaatcaatatgtaagagctcacaagtcagagtgagatgtttcttcctatactgcctgcttctaatgagcatccacttcattgaaccacctcttcattgagccaaacctaccatacagggatacattctctggaggaaagttgagcaactattgcatttgggacattagagtatgggtgggctgacaggtatgtgtatgtttattatccaagacagccaaggtgtttatcctgttacaacatcccagaggacagaggctcttatttgtgactcttttttcttacctgtaacaccagaggcataacgtacatcataatgctgcatcttgttgacgcttcaatgctcacaattcaaaggtgatttctgaagcactttgttacactggggacagctcctaaatcctcccactctttttttgcctcaccttggagtcttgggctctgttgatcactgactctgccaggtctttcagcaggcaagacagctcagttaaattgagtttggactccactgtagtgcatgcatgagacagcacccccaatccccaacacccacacacaaactttaaatatttgtaacagaattgttaccattaatattgcttaaaggctaacacattagccagaacctagatgtcttctggaaattttttattgcaatgttacttcatctacataaagttgtccaatcactgaaacctccaactgaaataaatggtaagctttttgttctcaat

SEQ ID NO: 999 - DNA, 2820 bp, Homo sapiens
agtactgcagtgtgcggcgcatggctgcgagggcctgccgaggggcgggcgcgagtcggaaagacaccgaccagggaatgggcgacgaggcttgccttaattcggaggaaacccaggacttgagagagccatacaatttgaaagacgaagcaccgtgaaatgcagaaagttgtggttcggatagctcagctgattaatttcatgttgccacagtttgtcagtgagttttgcctttttattttctcagttcctttaaaggcagtgcattcggtacttacctgataatgtgaaaaacgcgagctttagaaaaccgaataggtgtacatggtttactgtaatgacttgttctccaaagtaagagtaccaaacgctggaagcaaatagtatttcagtcattcgaagagtagtgcccaagcatttaacattgaagctgttaaaagggcaaagtaggccccaattttagatctaagccatcaactttatggaacagtcctaagggctttttgaaaaggagatttaaaaacacatttcagaggtggtagctgagttgaagaagtgaggaaagacttggatagggaggaaatagtttgacactgaaggatgttaggaagtagggattccttgtgcaacttaagagttttgtaaataagacggcttggccttgtgtcaagatacatcaattggttatagcttagtgcttggaggcccacattataggagtagactagttctccctccgccccgcccctggaaaatctatttcaagaccataaaccacattgctaatccttggaaatgcagaaggtggttaggtttaaaatgtggctttaaaatggtcctaacagaaacgtattgatgttactattcagaatatctgcccagtatacgaggaagaaaaaggttaaacctaaaacactaaaaattcatagttcatattcagttattagcctatgaagatttggtacagccttcatccttcattttagacaaataacaaatctatatggtttataagtgtattttgtaaggagttatatatatctatatatgtgtgtctccacccatctgaacctgacctgcaaaccaagaggttcttgtttatttccgatagttttggtagtcttgttaaaggcatttgattcaaaatccaaatttgcatacatttttccaactggatagaggaggcaggaatatatttgaatattgttctcacttattttgtccctcttcttattctttaaaaaaaaattaagcctgtcaattttagcagtgggggttgcatatcaattttagtgatactaatgttaataagttctgataacccactaccattggaccacccccactcttattcctaaaacgaatctgaaaataattagcttgctttaacgggaagaatgaatgttagggaaccaccctgctgaactccattttgctgtcggctctgaataaagctattttatccagaaaagctatctctggacaaatattttgaatagttcagtaaccgcaataggtttctgctagaaccattttgaagccaccctttaaccctaaccaccttatgtatttccaaggattggcgatgtagtttatggttttgggatagatttttctgggggaggggagaacctcccttctagctctctgcagattatcagagccgccactgcagggatttgctcccgtgggcctatatgtctccccagataccttcctaaaactattagcttttatctgtctgtgtattcccctgttgtgaatggggaagtatttgagggcttgtttttttaggttcttgataataaatacctcaggtttcacagagtaatcaaactaaaagaaaacttcttttttatttcattttatttttttgaccgaaactccatctccaaaaaaaaaaaagggtatattgttatgtgatattgggacatccgaacattttgttgtcataggagtttgtccttgccagcattaataaactgcttccttagctgtaaacatcttatgaccatgggttgtatctggtaaggaataggctttgctagtctaaatttagaattgattttgaaattgtgttatcctagcccttttttctttttttgagacacagttttgtttttgtcacccaggcaggggtgcaatggcgtgatcttggcgcactgcaacctctgcctcgtgggttcaagcgattctcctgtctcagcctcccaagtagcagagattacaggcacctgccacaatgcccagattatttttgtatttttagtagagaagggatttcacaatgttggccagactagtctcgaacttctgacctcaggtgatccgcccacctcggcctcccaaagtgctggaattacaggcgtgagccaccgtacgtggccatgttaccctaactcttatgttcctgtttccctaacataatacctcctttactcttctcctctactactctaatcttaaggggagatgaagggtgaaggtcattttttgtaacttcttcctgctgacagtggacgttgatctttgggacaggattctcttataagaatttgcagttggtgggctgggcacggtggctcatgcctgtaatcccagcactctgggaggctgaggcaggcggatcacgaagtcaggagatcgagaccatcctggctaacacggtgaaaccccatctctactaaaaatacaaaaaattagccaggtgtggtggtgggcacctgtagtcccagctactcgggaggccgaggcaggagaatggtgtgaacctgggaggcggagcttgcagtgaggcgagatcatgccactgcactccag

SEQ ID NO: 1000 - DNA, 1181 bp, Homo sapiens
ggcgtggtggtgcgctcctgtagtcccagctacttgggaggctgaggcaggaaaatcgcttgaacccaggaggcggaggttgcagtgagccgagatcgcaccactgcactccaggctgggcaacagagcgagattccgtctcaaaaaaaaaaaaaaaaaagaaaaagaaaatatagagatggcaaatggcacataacaagatggtcaatatcaattcctagtcactagaaaataggcattaaaagtgcaagataccaccataaacctatcggagaggcaagatgtcaatgccggactatgctgagtgctggagatgatgtggaggaatgggagcgttcatatgcactggtgaaaacgtcaaatggtaccaccttgtaaaactactggatagtttccaaaaaagttaaatatactcctgccatgccatccaaccattccgccatttatccacaagaaaggaacgacatgcccatataaagacttatacgcaaacacttacaggtgctttatttgtcatggacaaaaactggaaacacccaaatgtccatcaaataggtgaataaacaaattgaggtatatcaaacaatggaatacgtctcagcaataaaaggaatgaaaggaataaaaggaataaactactgatacgcacagcttgcagtgagccgagatcacgccactgcactccagcctgggagacagggtgagattccatctcaaaaaaaaaaaaaatgttaatagctccccagatcgatttatagatttaataaaatcataagcaaaatcccagcaggtttctgttgttgctggtctgttactgaaatcgacaaactgattcttaaatgtatgcggaaatgcaaaaaccaataaaatcttgaacagcaaacctggaggcctcacgttaccgaatattgaattattttaaatctagtgtggcactggcattaggacaaatagaccgatgaggaaatacattgtgctaggaccattggatctctatatggaaaaaattttaaccatctccctcataccatgcacgaaatagattctagatgattctacatctagccatgacaggcaaaccattcctagaaaataacataaaagattcatgacctggccgggcgtggtggctcacgcctgtaatcccagcactttgggaggccaaggcaggcagatcacct

SEQ ID NO: 1001 - DNA, 2648 bp, Homo sapiens
gcttcaaatgtcagacataactaatctctttttcccttcttcccttttctagcaaacttccagaaacaaaacagacaaaactttgtgatgataaatatcacagttgccacacaggccagcagaaacccaatcacatccaaagagtggtactggaaccaggcatatgagtacatgctcagcatcatgagccattttaagtgctgtaagaaagactatgaaaatgcgatgtgagaattatcatctgtaagttcctaaaaaggaattttatcaaggcacctatgatgttgagacaagttcatccagaaagctttactgatttgcttgtcataaggcagacatcatctgctctaatagttttagttaaagatgtaggataaacttcaaatttaagagtggatgcatcattgggatcaaaaagaatggaagctgaagatgccagtacagtcacctcatgacctctctgaacaagctctttcaggattgtcttcatattcatccaatggctgtattctgcggcccacaccagcacttttccacaactcccagagctaaagtaacaactgagatgtatcagcagaagaactgaagtccatttcagagtcatcctggtgcaatgcgatcattcttttccagtcactgtttctttctcatacttatatacagagataaatcaatcaagttaaaatataactcctccaatccaaagtaaatatattataggagcatcctgagtacatggatggcaaggagacaaacaaagttcgattacttcatatttactcaaggatgttttatgtttcttttatgtttatattcactgtcatccacctaagattaatgaccttgcaagtaccctgttttatgtaacctactttataatagtgtcaagaacagtggcaagtgagagagtcctgcagagcccttgacacagaataagagatgaaatgattgtacaatgcaaacagcatttttgaatatcgtggttcaatgaatatcttgtaaatctttgttggagtataattcaaataccatatgattcatcaattagtatttaaaattaagtatttcctagtaaattcacagacttgtgcatccaacgtaacaatcagttttatctaaaaaaacaaaaaactcctgtgtattagttctcatctccccaccaaatttctgcatccaccctgcactaggcaaccagtaatctaatttctgcctctagaaacacacctattcaggatctttttaaaagtaaacggaacaatatagtatgtggtcttttgtggctggcttcttttatttagtttaatgtttttaaaggaccatccgtagaatagtgtaaataaggacttcatttttattgccaaattgtatcagatgctatttataaacacaatttatttattcatttataagttgatagatattgattttcttccacttttggccattatgaatagcattgattaacattgatgtgcatgaattctgtggacatgtttttatttttcttggggatatgcctagaaaggcaattactgaattatgtggtaaatgtaaatataaccttttgaggaattgctagactttttcagagtgagtgaataattttctattctcaccaacaatgtatgagggtttcaatgtctccacaaccttgcccacccttgtctttcacataaccaaaaaagttattttttattttaatttataaacacactccaacagacccaaaaaaggaaggtttccttccacatattggagggaaaagtgaataaattaaataataacttacctaatacttcactgtaaaactaatctcacttctttttgttaaaaatctcaaatgcaaagtcaaaatgaagaaaatgcaacagatttttcacctttctacaaatgtgttttggtactaagttctgatatgacaacagttacatcagaaggaggtaatgtaagtcctccacagagttcttggtacatactgccagttgtaaatggatgatagtagaccaaatgtataacaaatgtttaacagactaagctgttcagataacagctcactactgagaactgacatctgcaagaatgacataaattctggaatcttgttgttcctcataattttcttgttcaaaacagcatactcaatgagcttttgaacagtatcagaacattcatgatatgtagtttttgcatctttgaatcatatgccaacaatgtactctttggaaacttatatgtccacatcttgatcaatttcataaatatgaaatcaagttccttctgagtaaaagatgtgggataaacctcaaatttaacagcagattgttggaatcaatgaggatggaagctgaaggtgacaagcacagttacctcatggtgttctgagcaagttcatcaagtatcaacattaaattgatacaaagactgtatttcatcggccacaccagcacattctcgcaggattcagggctaaaatacaactgtcagcataagaaacaaaaaagcccatttcttagacaacttgttaaaatgctatctttctttataactttctctaacttggtacatatcaatatcaatcaatgtcacaatgatttaagtattgacaatagaggttttggaaagcaagtgaataaagaaaaggatgaatg

SEQ ID NO: 1002 - DNA, 7017 bp, Homo sapiens
agaaagagtgctttcgccgtgggtgcagagggtgggcccgccgggttgggtggggggcgtgtgatgacggtaatggcgacgagatgctcaactcacgcggcctcttttaatcctcacagcagctctgcgtggagaaactacagtaacgtgttaccacgttaaggcgggaagctgaggcatgggagtatttagtaacgttcccgggccgtagagctgcggtgtgcggccgcctgatccacctgatctgtatgactcccgtactcaaccagcctatgtttcctaccagcgaatttttttttttttttttttttttttctttttttgagacaatctggctctgtggctcaggctggaatgcagtggtgcgatctcggctcactgcagcctcgacctcccaggctcgggtgatcctcacttctcagcctcccgagcagctggaaccacagtcgcctgccaccaccaggctcggctaatttttgtattttttgtagagacggggtctcgccatgttgcccaggctggtctggaactcctggactcaggcgatcctcctgcctcggcctgccaaagtgctgggattacaggcgtgagccaccacgccgggcctttccccgggaatgctgtggtagagggacccgcagaggccccgaggctgcctgcatgtgtgtgttgggaggatctgcgctgagggtaggtaggagttgggcaggccaggacaggaaggaggcagagggcatgtcccatgcccgtgcagagggaggacacgcatggtagaccaggacgaggacaagggcaggctcagtgtgtgcaaaggggacagtggtttgggatttgcatgcagatgcccgagcctccaaaggacctgtgggccacagggagaccctgggggagttcaagctgaggagtggagagggctttgggctggtcagcaggtgctcagaggagaggggctggccctagagagaagggaggtcttgggatggtggcccacacctgaccctggcccttcatcaggtgattcctgcgtggatgcctgcggggattcctgcgtggattggggaagtcctgcagcattacagaattgttacccaacgccagggccttggtccagagtcctgttgctagatgcacagaaagcaaatcactgagatgtaagtattgccagggaagaaggctttattcaggtgacatcagccagagagacaggagacgaaactcaggtccacccctgtccctcttcccgactaaagttgtaggttgatatagtctaaaaagaaagcaggagccaaggaagaggaggtggcccgcaggccgcaggagcagcctctcattgtccaaatgtaggtttctcaagcatccggcttgttaggaaattgggccagtttcagaatcatcagcttgttcaaaagtgggacttgggaggtgagaagggttgtcaggcaggaaaccctgcattctgctttggctgagtggatggggcccaggaggatgagcagcatggggaagagtatgactcgtagtgggcaccatgaggataaagagttacaagctcctctggcatgggctggagggaagggagaccctatcgcataaccacagccccacctgcctggagagaagagggaggcggccccgctccgtgccaccccactgagaaagataggacacctggagctccagctcagcaatccctcaatccctcaatccttcatttcatccttgcaacagtcccaggaggttttttttttttttttttttaaggcagagcctccttctgtcacccaggccggagttcagtgacgcaatctcagctcacggcaacctccacctcccgggttcaagcgattctcctgccttagcctcctgagtagctgggattacaggcatgcgccaccacgccaggctaatttttgtatttttagtagagacggggtttcgccatgttagccaggctgatcttgaactcctgatttcaggtgatccgcctgcctcggcctcccaaagtgctgggattacaggtgtgagccgcctcacccagccaggaggtatcaatggttaattctctccactgaacaaatggaaaaactgagactcagagagggcaggaatggccttggatgcagtgattccatggtgtggcctgagtcagatgccagggcccctcggacgcccgctccacaggagaggggtgactcagaggtgccgtgtctgtcctcttctcctgaatatgggtggttggtgcgggggcagggggtgagtcactgcactgtttcccatgcctcccacctcggctctcatggttgggagcggctgagggaggaggctgaggcagggagagggaagacccaggagggaggaggcaggcgctgctttgaggggtgccctggagccttggcaatccttttcctcctcgggcccgggagcccaggccccgtctccaccagccgcaggcgacagctgtcatggtggtctacagcctgggcctggggaagggctcagagcagtgtgcagctgcagccttgggcctccatggccaccagcagcatcctcaggcggcgcggcgattgcggcgggtagcggagggcgttgagcttctccatccccgggctgcgcaggaggcaggcgcgatggtgggagaaggtgtcgaaggagaacttgccatggtaccggcccatcccactggcacctgtacagtggcacagaacacaggtggtcaggcgctgggggtctcctagtcacagacagtggggcctaggcgggctacttctcccctctgagcctcagtttccccatctgtccagtgggctgatcatgaggcactgtgtgtaaagggcttggccccgagcttggcaccagctcagtaagccctggggatgccagatgccagggcaagataggcgggtggtggtcaagggcatggattccagagtcagactgccgggggttaaactctggccctgctgcaaacaatccatgtcaccttggactgtgcctcagtctcctctgtcgtggggtgacaagggtacctccctcctaaggttgtggtggggattgaggggatgttgagacccctggacccagtaggtgctatgtgcagtgaactctcctcagcgtctaggttgggaggcagacgaggccccaggccagggcgttcagagcacagcctgggtggagtggggttggctggggggcttcctgcagtgagtgagctccaaggatatgcagttaataagacgaagagagtgggtgggggcaagagggacccaggcttggggagccttagaggtgggtgccatgcggtgtgttagggacctgggcagagctcaggctgtgggagcagcaggtggggaagccggggtggggccacggccaccaagaagggtcagctcgggggcctgggagctgggggaggctttcttgagggagcagcagggtcagatgtgcccacagacagccccgactctcctccagggcagggaggcgggttgaggaggctggggctggggctggggaggcagctaggtggggtcgggggcagccgcccaaactcgagccgagccaggacagcagcacaggcactgttgtgcccctggctgccctccaggaagggcatggacccacctgaggcagcttgcctggccctgccatcgttcactgtggtgctgagtgtggacaggtggcgggactgcctgtcacctgctcggggcctactgttctctgaggaggaagtgggctcagaaaggggagatgtcacctgggccacagggccttcagcgtgttgctaggaccatctctgaggcttcctgactcagaggccaggactctgcagtggcatcggggctgctctggggggtggaggattggcactcatccgggcctctcagggtggggaggtgttgtactgagagctggaggggggatggggttagaggagcagctgccctggagtaaaggacaccggcggcattgctgctgaggggcagacaccaggtcatgctgttggggagaagagcaaatagcatcgcagtgggcagtgtgatcatagttgtgtggtatttttaaaaattcactaaattgtgtgtctgtgcagagatggtctagaaggttccaccacagacttttttttgagatggggtcttactgtgttgcccagattggactcagaccctctggggtggggagcaggatgcgggttctggggtgaggcctccttgcctgtccctctacattgaggtggggctggggtgctttggcagaaatgtatgcaggtaacactattgcaatttgaccaaatggtaacagaagggcagggtagcaggcacctacccactcctccaaaaggcaggctggccagggtcatgtgcatgaagccgtcgttcccacagaagcccccgctgctggtctgggtcagcacccgcttgaccacctgggagagaacaggatgtgcgtgaggctgccttgagccccatcaggatcctcaggacccagagcctgttccatgctggactctgtgacactgatcttgcctcagaaagggtctgaggccaccatgtcagctgaagggcctgtgatggtacaggtggggcagggggttgtgtagcagctcctcatgaagcttccaacttgggacatgtttcctggacatctgctcatgtgtggtccatgctgatggcacagactcttagggctgggggtaggggcaggaaacctagtgttgcttggggacatggagggtgtagtggcagcagggcagtactggacagtagggaggcatcccaggagaggggtgtcatgtgcctgctgagtggagggactgggagggacagaagttgttcaggcaaagagggcactgcagacagagtggaggctgaagagctgtgtggtgtgaacacagggacatgaaaacataatgatgtggtcagatttgcactttagaaacagaagcttggcccttgcttgaaggtccttgagaaggaccttcttcctcaatctgtagacttatttgaagactgaaaggaaaaaaagattggtagacactaaatagttgctgcacaaaaacttcagtatatttagttgcaatcaccgtgaacctctgatcacagctgggtcagggcttgtctgatgtggggaaagcggactgcccccagtggattcagacgtcacttcatggcatgagaccagcattacccacaatggcagtggcagcagatggaggagatggagcagaaggcagcagagggcgtcccaggtagtacgggcaagccaccttgtgcatgacttgtgtcttaggtgtgactgtgtgtcctgggatcagttctgggtggtcagaaaagtttgaagccagatgactccactgtcaaaaaacctctgtagagttttctaaaggtgaaagtatccagatgaagcagggctccttgaaggaatggctgcttctggagttggagcaggggagatacaagatgagcctggagctgcttgtagcaccagaggggaaggaggtggtcacaacccaagaggctgggacatcttacatgggcttctgagcccgagcctcagacaaaccacacgaccttggattacagcccctggagtcaaataaatatacctgagtccgtagtgacctaaataaacaattcaagagatgaatctttcttacagaattccaggaaatagatgtagatactgctgttagccaagaatacggtatccagctaagactatgcttcgtagatgaagaaataaagcctttcccagacaagcaaaggctgggggaatttatcactactagatcagtcctgcaagaaatgctcaaaggagtcttaacataaaaacaagttggtatttgccataatacacacaaaagtacaaaactcacaggccctataaaacaatcatacaaaggaggaagagaaaggtatcaaatggcaatacaacaaaattccaccaaaccacaaatggaataagaaaagaatgtataaaataactagataataactaacaatatgatagagcagcatacagcttaattacctccacctggtgagggtggggtaggcttagagacttgcttccaaataataaagaaacaaacaatagtagcttcccagggaaaccctggcagataccgtcctgacccggtagtgaaggttccactcactagccacgtgtgcatctcaggtgccccagatgtggtgtgagaggcaggctcacctctgtgggattctctcctaaaaccagtaacctttctttaatcatgagaaatacaccagatgacctgaggctggggatgttctacaggagacctgtccagcactccttaagctgagagggttattaatgcaaggtgggaccctggcttggatcctggggccgaaagaggatgtcagtggaaaaacagcaaaatccaaataaagtctagagtgtagttaatagtaaagcactgctgtcactttttttttttttttatgggtcaggagatccttccacctcagcctcccgagcagctggcattacaggtgtgcgccactatgcgcaactaatcttaaaaaaatgtttcatagagacggggttttgctatattgccagcgctggtctcaaactcatgagctcaagcaatcctcccaccttggcctcccaaagtgctgagattacaggtgtgagccaccgcgcccagccctgccatcacttttttagttttgacccatctaagcaccattaaatgggggaaattaggtgtggggtacatgggaactctctgtaccattttggcaacttttctgtaaatctaaaagtatttcccaatacaaagtttatttaaaaaaagttcaagtggccgggcacggtggctcatccctgtaatcccagcactttgggaggccgaggcaggtggatcacctgaggtcagcagttcaagactagcctgaccaatgtggcaaaaccccatctctactaaaaatacaaagaattagccgggcatagtggcacacgcctgtaatcccagctacacaggaggttgag

SEQ ID NO: 1003 - DNA, 10522 bp, Homo sapiens
gttatctgccgacagcgtaatgcgaggcaagtgccagccgttccgcccggcatacaagcttatggagcagccccctttgaagatctccaggtagacttcacagagatgccaaagtgtggagatctgattcctagattgggactgcccttacggatcagctcagataacgggcctgcgtttgtggctgacagtacagaagatggcaaaggtatcggggatcacatggaaaccgcatgccgcctcctggtctcagagttccggaaaggtggggcggataaatcggactatccaaaatggtattactgtcttccccgctggatattaaaaacaattccacaaggggcgtcaaaccacctgccaaatttgagggaatgttatcctctcccccgccccccgtccccagatattagagacaataacacaggggtaatgtatacccactgctttattgggagtaatatcatcctctcccttcttggatattaggaacaatatcacagtgtgcgtgtacgcctgtcgcgaaattcaatgtaatgtcatcctgtgcctctgtggatatgacgaacaatatcacgggggatgtaccacttctgagatattgggagtgatatcatcctctcccctctggaagttagggacaatatcacaggggtagtgtacactctctgtgatgttgggactaatatcatcctcccgccccctggatattgaaaaccatatcacaaggggcgtgtacacacacttcgatattggtattaataccatcctctccctctttggattttcagtgcaatatttcaggtggggtatacaccacctgcaatattggaagtaatattattttctcccactgtggatatcagcaacaatatcacagggggtgtgaaaaacccctgcgacattcagagtaacatcatcgttcccctcatgaatattaagaacaatatcgtggtggggggtgtacaccccctttgatatttgacatcatcctcttcccccctggatatgaggaacaatatcaggaagggatgtacagaccctgagacatttgctgtcatataattgtctctcccctagatattaggaaaaatgtaactggggatgtgaacacccctgcgatattgggagaagtatcatcctctcccccgttggatattaggaacaatatcacaggggaggtgtactgcctctgggctattgggagcaaaattatcctctcttcccctggatattaggaagggtctcagagggggagggtgtacattccctgcgatattcaatgtaatcttatcctctccctcccagggtattaagaacaatattacaggaggggtgtacaccctctgcgatactaagagtcatatcatcctctttggctctggatattaggagcaatatcacagggctgtgtacaccccctgcgatattgggagtaatatcatcctctccacccaggaaattactaactaggtcacggggggtgtactccccctgcgatattgggagtaatgtcgtcctccctaaacctggatgttagcaacaagatcacagagggggtgtacacaccctgcgatattggaagtaatatgatcctcttcccccccaccccagatattgggaaaaatatcacagcacgggtatacatttcctacgctgttgggagtaatatcattcttttcttctctggatattaggaacaatatcgcaggggtggtgtacatttcctttgatattgggagtaatatcatcctctctccattgggatattaggaacaatatcccaggggggtgtctaccctctgcgacattgggagtaatatcatcctctgtttccctggatattagactcaatgtcacaaaaaggtgtacaccccctgtgatattgggaataatatcatactctccttccctggatattagaaaacaatgtcatcaggggtgaacacccgtgcgataatgggagtaatattttctctttcacaggccattaggaacaatatcacagagggtgtttacacaccctgcgatattggaggtaatatcatcctctgccccccggaatattaccaacaatatcaaacagaggttgtgtacacttcctgtgatattgggagtaatatcattctctccacccccggatattaagaacaacatcccggcggggggtggtacaccccccagtgatattgggaataatgtcatcctgtccttccctggatattaggaaccatatcacaggggggtgtacaccttctgtgatattggaagcaatatcatcctctcccccactggatattagaaaaaataccacacatggtgtacacccactgtgatattaggaagaatattacagggtgtacacccactctgactttaggagaaacagctacctaaaatgtcacaaacaatatcacagggtatacagtaatatctccctaggatattacaaatactattacagggtgtacacccactgcgataacaagagaaatacatcccaaggacattaccaataatatcacaggctgtacacccactatgacataaggagtgatatttccctaggatattacgaataacatcacagaatgtacacccatggtgtgcacccatggtgatattaggagtaatatctacccaggacataaccaataacagcacagggtgtacatacatgatgtacacccatggtgatgttatgagaactatctccctaggatattacaaataacatcacagagggtacacacatggtatactcccactgtggcactaggactaataactttctaacatatgaatagcatcacaaaatagaaacacatggtgtacacccactgtgatattaagggtaatatccccctaggatattatgaataacatcacagggtgttcacccatggtgtacacatgctgtaatactaggaataatatctctctaggatattatgaataatatcacagggtgaacacccactgtgatattgggaacaatatctctctgggatattacggattatatcacagagtgtacacacatggtgtacacccactttggtattaggagtaatatcttcctaggacattacaaataatatcacagagtgtacacccactgtaacattaggaatcgcatctccctagggtattacaaataatatcacagggtgtacacccactgtgatattaaaagtcatacctcagtcagatattgtgaataatatcacggatgtacaccacgtgtgcacacccactgtgatttttaaagtaatacctccttaggatattatgaataatatcaaggagtgtacacaccccatgacattaagataacatccctttaggatattccaaataataacccaggctgtataccccatgtgacattaagagtaacatcttcctaggatattacgaataagatcccagggttgacaccccctgtgattttaaaagttaaatccccttagaatattactaataataacacagggtgtacacccctgtgatgttaggagtaacatcctcccaggatattatgaataatatcagaaggtgtacacacatggtgacattagtagtcatatcccgctagtatattgtgaataatatcacagggtatacacacctgtgacattaggagtaacatccccctggaatattctgaataatatcactgggcgtacacctcctgtgactttaggagtatcatcctgctaaaatattacgaataatgtcacagggggttagcctgtgtaatatcacagggtgtacaccccctgtgacattaggagtaacatctttctagaacatcacgagtaatatcacaatgtgtacaccccctgtgacattaaaagcaaaatccccctaagatattccgaataatatcacagggagtacaccccgtgtgacataggagtaataatccgtgaggatataatgaataatatcagagggtatatacgtattgtgacattagtagtaacatcctgctaggatattacgaataatatcacaaggtgtacaccccgggtgacattaattgatggaacagtcccctagaatatgaccaataacattacaaggtgtagaacacctgtgatttatgagtaagagttctatagaatattacaagtaatatcattcagtgtgcaccccgtgtgacattaggagtaacagcccacgaaactgtgacaaataatttcaaaaggtgtacaccctctgtgacattaaaagtaatatcttactaggatattacgaataatatcacagggtatacagcccctgtgacatgaggagtaatgtctttttaggatatcgcgaataatataacaagatgtacacaccctgtgacattaggtgtaacatccgtctaggagactatgaatactatcgcagcgaacacaccccctgtgacaataggagtaacatccccgtaggatattatgaataatatcacaaggtgtacacacattgtgacttcagtgctaatatccctctcatatactgtgactatcacagggtgtgcacccctgtgatatgacattaggagtaacatctccctagagtattatgaatactatcatgagggtacacacgcctttggtttaggagtaatattcccctaggatattacaaatgatatcacagtatgtacactcactgtgatattaggagtcccattttcctaggatattatgaataatatcacagtaggtgttcacacataatgtgtacaccatgtgtgtacacccatgtgatatttgaagtagtatgtccctaggatcttatgaataatctcaaaaggtgtacaccccatgtgacattaaaagtaacgtcccttttggatattccgaatgctatcacagggtgtgatattaggagtgtgatattgggagtaacctcttcctaggataacccatgtgatattaggagtaacctcttcctaggatattacgaataacatcacagggtgtacacccctgtgactttaaaagtaacccccccatagaagattatgaataatataacagggcgcactccccctgtgacattaggagtaacatctccctaggatattatgaataatgtcactgggggcacaccctctgtgatattagcagcagcatctacctaggagattacgaatgatatcacagggtgtccactcactgggatattagaaggaatatctccctaggatataagctatcacatcacagagtgtacacacatggtgtacacccactgtgttattagaagcaatatctccctacgatattatgaaaaatatcacggggtgtaccctctgtgggatactagaagtaatgtttaccatggatattacaaataatatcacagggtgtacacacatggggtacacccactgggatattaggagttatatctctctaagatattacaaataatatctctctataagattacaaataatatctaagggtgtacaccccctgtgacattaggagtaacatccccctacaatattgggaacaatatcacacggtgtacacccctgtaacattaggggtaacatccccccagaatattactaataatatcacaagatgtattgtgacattagtagtaatatcctgctagcatattttcaataatatcacagaaggaacacacctgtgacaataagaataacatccccctagaatagtaagaataatagcacagggtgtacaccccctgtgacattaggagtatcatctcactagaatattatgaataatgtcacagagtgttatcttctgtgacattaggagtacagacccctgggaaattatgaatactatcacagggtttacacccctgtgacattaggagcaacatctttctagaatatcatgaataatgtcacaatgtgtacaacctggtgtcattaaaagtaaaattgccctaggatattatgaaatagaacacagggagaacacctcgtgtgacattagaagtaacatcccctgaggatataacgaatatgaggcatttgtcccggtgggacgccccccagagcagtgtgtggcaggcccccgtggaggatcaatgcagtggctgaacacctggaaggaacaggcacttggagtctgcacatctgaaacttggtaagactggtctttgaaacttgctcactccgtttgagtggaagcgtggcctgatcacccacggcgtgcctgtacaggcactttggttttggttttgacttggtttgaattgcttgacgggactggtcttgagaacttgcccactccatttgagtggaagcatggcctgatcacccacagcgtgcctgtaccggcactttggtttttgtttttgatttgacttggattgcttgatactttggttttggttttgacctggcttagatttctggttactctgattttggttttgatttttgtttggtgcaaactgcaaaactgtgtgtgtgccctttttacccatttttttgttttgtggtgtgcgtgtggagtgagcatggtattttgtctcaaagaagcataggtcaggcacaaataagcccaccctactaggaactatgttggaaaatttcaaaaaaagaatttaagagagactatggagtactgtgacactaggaaaacttaaaactttgtgtaagatagaccggccagcattagaggtagattggccattagaaggaagcctggacaggtcccttgtttcaaaggtatggcacaaagtaacctgtaagccagggcacccagaccagttcccgtacatagacacttggttacagctggttttagaccccacgcccccaacacacagcggttgagagaacagcagcataagcagatggcagaggcaaggaaagagcagcagagagagagagaggaaagagacagagaggaagagaggaaaagagagagaggaagagacagagaggaacagacaaagagggagtcaaggagagagagagaaagagagaggcagagagaggaagagacagaggcaaaaggaaagtcagaaagagagagacaaagtcaaagagagaaagaaagaaagagatatacaagtagttaaaaaaaagtgtaccctattctttaaaagccaaggtaaatttaaaacctataattgataattgaaggtattctccgtaaccctataacagtccgataccactttgttgtcagtgtaaacaagggcatatcccgaaagcactgaggccttcctatcaaaaatccttaaccccataacccgcggatggcccaaatgcattcaatctgtagcggcaactgcttcgctaacaaaaaaaaaaaaaaaaggggaaaaagaataacttttagaggaaacctcattgtgagcacatctcaccagttcagaagtatcctaagggaaaaaaaaaaaaaaaggaaaaaaaagggggcgggtggaatttatataaaaagagtattatatggtaaattcttgtcctgaaataaattaactggttgtttaaagaaagaaatatttgtaataagtcagaaagttgaggcatgtggaagaattgtctgcaaaagtcaagaaagagaaaaatgttataaaaaagaatttatgcaaaaaatgttgtataatttaaaagtaactaggcctcctgaatgtaaaactattgaaaaaaaaaaaaaacaacagtttatgtgcaaggtgtataagaaaagtaaaatatatctttggtaaaaggattataaggaggcataagaatgtacatttttacctacattaaaaagttaaaaatttattgttttgaaggtttaagcaaattttaaaacattaattgtaaaggaaattctgtgtataaacatatttgctaaagttaaagaagtatcatccagtttttctgtgaactagacattaaagtaaaagcataacaggtttttcttaaagcaccaacctgctctttagcaaaaattatgaaaggttaaaaagagtctataaaatcgtaacttacggtcaaacattaaaaattagataaatatgtctacaggcttttattaaaattaggtttaacattaataacacactaatataaacataacatttagcttatctggtataaaaatcatacaagaagcattgttaaatgtaaaatggtatttggctttctttggtttaaaaactaataaaaataggtgctaaaggaaatttctcagtaaaaagacactaaggactataaagtccactgccaaggtccccacatttaaaacaaaaggtcagtttcttaaaaattatatacttggtttatcttccactttcctttctctcaaaaactaaaagtcttttagcacatgtaccaccgctagaatttccagtaaatcagcaccagcctgaagatcacgttctcatcaaagggtggaaagaagaaaaacttgagcccgcctgggaaggaccctaccttgtcctgctaaccaccaagactgctgtttttacagaaaaaaaaaaagatggactcatcacacccaagtcaagaaagcgccaccccctccagaggtgggggccatagtcccaggggaaaaccctaccaaactaaagctaagaaaaatggaggaaacttcgtgttccttggagacctgaaaggatgcagtgaagcataagaattttcaagagcttatcaatgaggcagcccttgttcatccctgagcggatgtgtggtggtattgtggtggacctttactgggcactctgccgaataactggagtggcacttgtactttagtccggttggctatccctttcaccctggcatttcatcaataagacatcataaagcgagagaagctccttaggggtctttcaactctcatgtctatttagacgcaattggagtcccacgaggaataccagatcaatttaaagcttgaaatcaaatagctgcaggatttgagtcaatattttggtaggtgacagttaataaaaatgtagattggataaactacatctattacaaccaacagcaacgagcttttcatgagttaaaagaaaactcacgtcagctccagccctgaggctacctgacctgacaaaactcaacattctatgtgtcagaaagagaaaaaatggcagttggagttttaacccagactgtggggccctggtcaaggctagtggtctatttctcaaaacaactagacagggtttccaaaggctggccccacgtctaagggccctggcagcaacagccctgttagcacaagaagcagataaactaacccttaagcaaaatctgaatataaagaccccccatgctgtggtaaccttaataaataccaaaggatatcattggttaacaaatgatagattaaccaagtaccaaatcatgctatttgaaaatccccacataaccattgaagtttgcaacaccctaaaccccaccacatttctcccggtatcagagagcccagttgaacataactgtgtaaaggtgttggactcagtttattctagcaggcctaacctctgagaccatccttgaacatcagtagactgtgagcagtacgtggaggggagcagctttgccaacccctgcaaagtgactctgaagaagacgacaagccctactccagtcacacctggaagctgactggtccacacacagccgaagcatgagaaaacccattgcgggactcatttttcttaaaatttggacttttacagtaaggacttcaaatgaccttcctcagactaaggacagttcccattgtatacatcaagtcactgaggtaggacaaaaggttgctatggtcctattattttatggttattataagtgtactggaactctaaaaagaacttgttcgtgtaatgttattctatacaaagtatgtagcccaggaagtgaccaacctgatgtgtgttatgacccatctgagcctcccatgaccatagtttttaaaataagattaaggactgaggactggtgtggactcataaatgatacgagtgaagtgttagccaaaacagaagaaaaaggggtgcccaaacaattcatcttaaaatttgatgcctgtgctgtcattaatagtagtaagttaggaataagttgtggttctcttcattagaaaaggctatatggcagaaaataaatacatctgtcataaattagcactgtgtggaaataaatgtaaacactggtcttgtgtcattttggccacttggacaaaaagaaaatgaaaaagatccagtccaccttcagaaaggaaaaaatggcccttcctgtactaagggacaatgtaaccccttagagctagtaataaccaagccccttgaccctcgctagaaaaacagaggagcgcgtgaccttaggaattgattgggccagactggatcctcaactaaatatcttggttcaaggagaagtttacaaacgctttcctgagccagtgtttcaaacttcctatgatgaactaaatgtgccagtaccagaaatttcaggaaaaacaagaaatttgtttttgaaattagttgagcatatagcccagtctctcaatgtcacttc

SEQ ID NO: 1004 - DNA, 27605 bp, Homo sapiens
ggggcagcaagggcgcgctggaggcggcggccaagactcccgccgccgccgccgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatccgaacgagacaccacgtcaaccggcgcggggagtcccgtgaagacatgagggcgccaggagcgcaggccgggctttcctcgcgcctgtcgaaggccggccttcccgctcgggtgtctcgccctctcgcttctccgcagggcaggaggcagtggcgagaaaaggagctgccggccggagttctagcaccgagaaggagagatgaggacattgaggatcagagatgttgaaaaacttgcccaaggatgcacaagtggaatggtaaagacaggatttgaattctgacctctctgactccgtgtcacaaactcctgaaagtgtgaaaggtttaacacaaattccttccccgctctttctctctctccctcccccctccaacttttccctttcaacaaatatttgaaaacttactatgtactgggcactattttaagcaccacatagcaaagaaacaattttggtcctttttgatcctgatgatcccccatccctcccttaaatgtttttccttccccaggtccttccctaacttttgtggggccctgcaagtgtaaaaacagaggctcatataccatacctaaatatttaaaagtgataaatcaagctggcaaagtgttaaataaaagatgctccatcctcctgccttgataaagacacttgtgcacaagggctgctgtgcactgagcatctgtgggttttggagcaccatggaggaatgtggtggctcagagggtgtggacatttagcccatggcctgtggcctgtccctcatttcttcccaccctggcagtccacataagggggtggtacacatatgtgtgtggacatcctagcctacacatccaagctgtatcccacaaacagcacctcatggcttaggggtgtgtgcactggcggtgtgacctgccgtggagagaaaaggcctggggaaagctctggaagtggacttaagaccacttggacaggggattcaaggtctctcgtagccaagacatagtctgaaagaggagaggcaggctgcagcctccaggtgggtacatctctgtgcccctcaactcttcactccataggaaagggcacaaccagaggagtactgtgggtgcccctttcctgggcctaagagtaacagcgctcctccccgttctattttgtcttccaaatcccacgttcacatgtggatattttttgagatttggccatctgaggatttttataaaggaaaatgtggaattcaaacactctacttgtttaacagagagcaggtccattgaggtgggcagatgttagatgttactggaagtggaggaatgggattttggagagacccgctggcctctctggagctacatggacttccctgcattcagcagccctagtctacagagggagaagctaggctaccccggccttctgtcttgagaccttgatgggttcatcccaaacctcgggaagtggatgcagtttagcaggatcagctctgcgccctgttcacttctccagccatgaggactgcagctctggatagactcctaaagcacacacgaaagcagtgcttcctttactgggccagattctccccgggggagcagacagaagccctctaacctgagcagtatgtgctcatgccagtgtgcattttcctgtctcccctggggaaggtttaaatcctttatttattaagaatttaatttctttatttattggtttaaattctttatttattaagcctgcacaatgtgatagaacactatagcagacagtcctcgatgtttaattcttaagaaaataggaaactatgtatacatttccctccatttaaattctattcacttctctctttgtgttaggggaggtactgaggaacgctgttttcatttgcttttacttttaatatggtgttactcagaaccagtagggtatatctattaatatatctgtatctatatctatatcacctatatctctatctatctatctatctatctatctatctatctatctatctatctatccatctatctacctacctattatctacccatctatattatctatctgtctgtctgtctgtctgtctatctatctatctatctatctatctatctatctatctatctatctatatctgtctatagatagatacatgagaggggatttttttaaggttttaattttgatacaggatctccctctgtcacccaggctggagtacagtggcacaatcatagctcactgcaagcctcaaactcctgggctcaaacgatcctccagcctcagcctcctgagtagttggaactatagatacacaccactgtgactggctaatttgtttaatttttattttgtagagatgggtggagtcttgctatacctcccaggctgatatcaaactgctggcctcaagcgatctttctgcatcagcctctcaaagtgttgggattacaggcgtgagccaccgcaaccagctggaagctggatttttaatgtttcaaagtagagcaagtggggtcgcccattagggaacacatcccaacaccttttctcctctgggtggctcccatgttcatatctcacaaggtgctctgtgcttcaggatgtctctgcagttgctcttcagcctcctctcactacacgggccaagggcactgtttgatgtttgcagcgtgtcctcttgcctcccttcaacccttcaacttatctctttccatttgcattatccctggccagatatatgctgggggtcactcatacggactcacaaaggccaatgttaaagtttcaggaatgttgtgaaccacttattaaatacagccattataaaagtgaaatggcctaaacttacatttaaatatatttcattaaaaacaaaggtagtaataataataataaaaattcattacttacaaattattttactatatgttactattatctatgctgttggggttatttcagtctattttaactgcagggtggaaatattgtataacagtgtgctctgctatgcccttttcccaactgtgtgtttcaaaatgatgtctcgttggagcttgaaatcagccatggttgtagtatttatttcatgtaaattggtaaacattatgaatcaggagtccctcccttatccagagagcctgttgttaacatttaccagcacaccatgatctgtagctctcaaatccttagatcagagtttctcagttctagcactattgacattttaggccaaataattctttgtttttttgggggtgtcacttgcattgtagaatgttgagcagcatttctggatgccagtagcttcccctccccagttgtgacaaccaaaaatgtctccagatgttgccgaatgttttctgggggataaagttatctccacttaagaaccactggcctagacaacattatcctttaatgtaagtgacttgctattcttcccttttaaactttaacatgcatctgacaaatattcagtgcccattatgcatgtaaatacaatgatgaacaagataagcattgtccctgtcttcatagaactccagtctaaaatcatggactaagctggaaatatactgagtatccactaggactagaacatgctatctgcatgctaatgtgctcagtaggtgatcttgatctttattaattccattaacactaattgcaacattgtataatgtttgcatttccccttcaggtgactgttgtctcttgggcacaggtagctgccaacaggtgagcctctcagcggatccctgatagaggtaggatggcaaatagcttctttaatatgacagcctcagtgtagtggctggcaaggagctgcgattgggaggaactggaagtgacacccaagctcattgagcaagcatgctgtgagtgccatgagtaagtagtcccagctgatgagcttatcagggggttgccagcgggggtactgcccagggtggagatggaatgggagacatagccatacctcagaaggatatgcagctcctacgaggacctaagtggagctgggtcagcatggccccagtaagcacacagcaggcagatcagccacagacttcagcatcaaggccttccagggtgggaactagatgaactggaggacaggccaggaacctgcacatatgaatcatgtgggccaaggaccttcctcccctttcctaccaccatgaagcagacccttcccccaggagtcatcttggagaaaaatgggaaagtggagcagtggtagggggcagggggtgctgcaataccaaaatatccagaaggcatttaaaattattggactagatgacatttaattctccttctttactcagtaaagtgaagagctcaggagaaagattggatcaattatagaaaataatgaaggtacattttctttgcataactaaatgtagggtaagtacattttgaatttgctaaaattgtctttgctctgcctctgcacacgtgtgcacacgtgcacacacacaaatggcacttctgggagtttttccttgctaccacctcctctcaataatcaatgctcacgaaagcatttgtgagaaatgtggagtttactgtggagattcaaagggaagatgatggaggtttcactgtaacccccacaacagattcatattccactttgatactgtgttcatcatttccaatatatacctttttcctagttgagtatttgaaatcttggaaaccagactctgtcttgctgtgttggtgtgtcatagtataattggcagcatgtttcctttggtagcaatacataagacaatggtgtgtcttatgttgatgtcttcttatatttgataaaatcttttaagtctactgctttgcagtccttcctcaactgcaagcagaggcttccccactgaggccattgagtaaagtggttcaaagtacagtctggagtcagaccatcacttactatctccaccattcacaagccaggtaaccttgggcaagttactgaagggttcaggggctttgtttccctacctgtgcaatggggataatattattaactacttcatcggattgtagtaagaattaaatgagttgatatatatagagaaattggaacagtgtcaggtggtggtgacttctagaaaagtagttgttcttatacgtattacctctttagtcccctcccacataggccctgcctcctgttacctattgctttttctttcctcccttattttataaataatacttcagtgaccgctgtttgctatttgaacacaaccttgagatctctcctctccttcccaaatggcttacctaagtatttactccaaacaaatatgttgtcttttagagatactctgataagtaaagattgctgtatgtagtaacatatttttatcattatttctgatgcatctatggtagatgcaagagatagtaagatatgagcttgactggagctgagctagcttgttggggagcattaggaaataggatggaaaaaagataggttggagacagatggcacttgaagaatctcccctttgaaatctttggtaaagtctacaatatgatacctctccatacatctctaaggaggctttgtattttgatgacagccttgaatgctagggacacccagccacacgggctaactcatacagggcagagaggactttcaccctctttaattcaccgtgtatgagtggcaatgtttcttcccaaatatatggctggccctaggagacaagtcagggcatgtgagctgtggatgtgaactgagagaacagttggggcttaggtgaaaagtggagattcaggaactcttcagatatagtggccttagggaaagatagatgtattaggccattcttacattgctataaagaaatacctgagactgggtaatttataaagaaaagaggttatattggctcatagttctgcaggctatacaggaggcatagtgctggcatctgctcagcttctggtgaaacctcaggtagcttttaatcgtggcagaacgggaagcgggaacaggcatgccacaagttgaaagcaggagcaagcgagagagattggggatggtggtggggggtgttacagacttttaaatgagcaggtctcataacaactcactcactattgtgaagatggcaccaagccatgagggatctgcccccatgatccaaacacctcccaccaggcccctcctccagcattagggattacgattcaacatgagatctgggtggggacaaatatccaaactatattactaggcagtaacaaagagacacccggcccttctgggttcaaggtgtgccacaggcctgcatgtcctcctaagcttttcttaggtggtgccagagtttgaatggctgcagtcctggcatattcctcagtgaggctggaaaaaataatccactcctgcaaatggaaaatttcttctgtgtagggtgagcacttccagctccagaaatgaaacatgctaaaggcagcgtgtgacttggcatggggtgaccagtaacccaactgatcggtcctctaacctgttagttcattttgctggtgatcttgtccataagggcaaacaactttctagctggtcacctttggaacaaagtaagagtttttgaaagaggatttaaaaaaattcttttttggtttgttttgggtttaatgagtcaatgctttattttactatgagtgtttataaccagacctaaatgtatgtaggatcttgaacctcccccacaactatttcctatttgttcccagaaaaattccaatgccagattttgccatagcaaccagaggcaaatatcaagacagcaataaagagcaagctggaaaagggtttccctacaatgtggcttgagtttctgtagggcattccatcctccgtgtggagctctggaaggcaagagggggccctgcggttcctcgtgggggggtctggtagagtccagatttgccagcatccaggacccactaggaaatgtgtctgtcaggcagctgggctggagcggaaggatcagcttgcctgctcctcgggcttggcacctgttgtgtgttgatctttatttttgtacgtcaatttttcaaaattaaaggtattgaattattatttttccattatgcttttcctctgagcagtttagtaaacaagcctgttctgtatttcctaattgtcccctcaagtgctctttggaagaaggcagtgcatatttaaaagtaagcaaatgaaaccaaagaacaggagattcttccaatatctgcccacgatgtccctcattctgtgtccttcctttttgtcatggttgttaggtaatgttaggaagtcccacttctttcccataggtaaagtcatctcactacagtatagccttcttgctgaaagaactttgggcttccgagttacttcaggtgctggtttggattagcggtgtgttgataaatgtttaacaactcgctcgcagacataaaattgccttgatttgtagagctgatttgctgatttctgtggtgtaaatcctcccaccatggcagatttcatcttaccagagtgacctcatgaacatggaactggaaagagatgcacacatttaactctcatgcactggtaagagctggctgccccacactgctggttctaccgatctaggcctgggtttctcaacctcagcactattgacattttgggcagaatggctgttggttattggtggctgtcctgtgcattgtaggatgtttagcagcacctgtggtttctactcactagatgccaggagcaacccttccccactaagttgcaacaaccaaaaatgtctccagattttgccagatgtctcctgaggggcaaaatctcccttagttctgggctattctgcactgatagtgcttagaaggtccattcagcaggcagtaggcctgcactgttagcttttccatgaaccactctgaatatgcacccaaagaagttctctcttggcattttggatgtggtgcattagtctgttctcatgctgctaataaaggcatacccgagactgggtaatttataaaggaaagaggtttaatggactcacagttccagatggctggggaggtctcatgatcatggcagaatatgaaggaagagcaaagagatgttttacatggcagcaggcaacagagcctgtgcaggagaactcccctttataaaatcatcagatctcatgagacttattcactatcatgagagcaacatgggaaagtcctgcccccatgattcagtcacctcccaccgggtccctcccacgacatgtaggaattatgggagctacaattcaagatgagatttgggtggggatacagccaaaccataacatgtggtattgcaaaacactgaaagtgtgcttccttgggtagtcttgagaagagtcatgctgtaaggacttaaggcaccaaaaaattaagacacagcagggccagtaggagagcatcagggtaattccactataggatatatcctatatccattataggatagttttgacagactgcagaggtcccttaggcaaacctttcctttgtatgggtgagaaattagactcagggacaaggtgtgacttgtccaagggcaaggtgtggatgtgcttggacagtcacaggggtgttgtggtgaatgctgtgagacgcctgtgtgacatactgggaattagaactgactccaacttgtagctaaatgtgttttgcgggcttttcaatgttgggtttggatggatatattctgacatctccctgtcccctacctctctgtccctttggaaatatctgcttatgaaaaccatattataatgagggatttctgtttcagatagaattattcccttcagcttcaggagtgagttgattattcacatgttctttttagggggtttaagctgctagtccttaaagaatagatgctgaaggttgtcattgattcctctttccttcctcccacgtctgctctgggccttctcattgatgtagtatcttaggttacttccaaaataatttgagaaatggatttatagaagaagctagctttccagtagaaaagtttagatgacaagattaatgtgataagaactaagaaagcccttcctagttttcattgaaaatgtgtttttaatgcccagaggtgcccagtcaaaaaggaaatattacagaaggattattttcatcagcagagttcttgggcattgcaagttccagtgtaattagggaaatcacatgcgagtacatcaatacacttcagatgccaatacattgggcttaatgaggacaacaagcctgcttttattaggggattgaataaaagtgaaaggagttcttgaaaagaattggtaattttggatgggataattcatcacttcactccagatcagtttttcacagtaagaagtgctggctcttcagaaaatttggcataaccaaagtttattgtcactatctcctccttctcacattgtcctttgtcgcacccccagcaggtccacagtgatcctgcgggccacccccatggaccctgcccgttttcttccatcgggggctatcttacgtcagtctttcaaggtctcctcagtaatgcaggccagttggatttttgctttcttttcccagaggacaattcagcctcagcgtcttagtctaaaaggattcatgcaagcgtgtcagatgttttattaggctaagggggaggtattttgggttgtggggagcacttactgcaaccctgtatgaaattccctactcagtgatgttcaggctgcacgggccaacatggaaagggcttaagggagatgacaaaaacaaaatctcttcttccacaaagattttcagttgatcaattttgttacttttttgtgatgaaactatctgcactgcagctaatgatttttttctgaaggtggaaaaggtaggagcaacagctttcagttctaaggatacattctgttgaccttcataagccctaggaactagaggggcaagattgaggaggaaatagagaaaataatttgctctatagtattttccccctgagctgccatctggggctttcagagcttagcactgcactcttgcaatgttgcacacaccacaggagcaatatcaagagatgtcaaacatgagtggtattggtcactggaaacagcagattccaaatagctgtctcaccagactattctttcagaagattcatttgtgccaactacttctttgtcatggatccttcctggttctgcaacacagatgtggaaagtgaagagaacacgtcatggaattccatttctaagagtggaaaatatacaatttaccatgggatgtttaagatattaatatattgttcaccatgtgtatccagagctttagtagaagtaggttaaaagagccgtgcatgtatacacggtgctcctcattgtcaaacgctgaagcctgttacaggctgggtttgggggctgggggtacttacgggacaaagtctgactctcggtctgtaggctgagtgccttcttagtgtgttgggactcagcatgtattcaccccatctgtactcacaagcctaattcattaatcaggatgacttactgggctgtgagccctttgaggacaggaccttgtacctttatcttgtgcctctcatgcctagcatagcaccaggcatgtaacacgttctttttaaaaaagtgttttacagctttatcaaggcatacatgatgtcagatcaactgcatgtgtttaaagttttacacttgatgagttttgatatatgtctatacccgtgaaaccatcactgcaatcaagataataaacgcattcatccaccctaaagtttctcgtgtccctttgcaagccaccccccttcctcccattgttcccagacaaccactattctgctttctgtcactgcagatgagtttgtgttttctggaattttatataagtggaatcatacaacatgtactctgtttttctggctgttttcactcagcataattttctcaagattcattgaagttttatatattaatagtttgctacatttcattgctgaatagtattccattgtataaatcataataggcacctaacaagtgtttgtggctttacactgacttgaaaattaatttttaagaatataattgggcaaaaagtggacaatgggataccactctattcttggtgagtgggttcactcaggaagtggaaataagaatcaggagataatttggcatggtagagacttttgttgtcatccaatatctatttttccttctttcttagtactggaatacctgagttttggctgggcacagaactgtctggaatacagactgcaattcccagccttctgtgcagttctgtgtggccatgtgactaagttgtggtcaatatgagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaaaacttctgaggtcatttaagcaaggactatcgttatccccggaagcagagagaagttccctttgcccaacatcacactgcaagcacgtgttggagctgagattcaaacccaggcatccagggtccagggcccatgcttttaatatattccatatcttaggagaatttcccctatttaaacaataaaagtgcaaaaatcttgtggctagccaaaattttcagttgtttggaaaacttatttatccaataagtggaaaactcacttgtcctccaacaattctggataaatgaaagaacgaattgaactgagactggaatccgggtctcccagtactttgtagttcctatccatatggcttgtcaggaaggccacagggaggttaactaactctgcgtaaccagaaacaatcccacatcagactgttggcagtgggagtggaacactcagagctgaaccgcatgcaagatggttgcattttcatttgcaatgtcgtcatcttcctcatggctaaagaggtattttggagttgacatgaaggctactgtaatttttagaggcattttctttctggcctgtatttacatattgtggtagaagagtcagaagacttcaagcttcaaaagtgaatcttgttgcgagttacaaaagcaccacccggtggggtgcagctctcagcatgtgtcaccacaggcactgtgatttccctgtcttcatccaactttggttgctgttcttcatgctcaggaattctgcaactgctgtagcttttgctgttgttatgtctgtaggtatggactcatttctaccattctggaatgaaacattatttcaagggaagcttctcattgtaaaaggtccacacattcagaaggaaactgggagtacattttctcataggcctggagcattaactgactatgcatctttcccctcagtgttgtcatcatgttgtaaggggatgagtcatggacaacattttcacacacatacgtgaggtccattgaccagtctttaggacaactagaaatcttttctttctttgttttaaaaaggaagacaagtcaagatacagcaaataaaaatgctcagcacatttgctgaaatcttagcaaaatcaaattactagtaatttgttaatcacactatacctgttttgagccaatcctacttaacccaccctccatcttcctcatgcttgcctccctggtgaactcctatttatgttacaaagctcagtgtttatgttactacttttgtgctatttctgaacgttaaatgtacctctattatagaacatatctcatggaatagttattattgcatatccactgcccttgttaggctgtgagtgagctttctttctttctttttctttccttccctccttccttccctacttcctccctccctccctctctccctccctccctctctccctccctcccttccttcctttgctccttctctctttctctctttttcatttcttttctttttttttaaatttgagacagggtgtcacaaatatgaatgggacctgtgaatatgatggctgtcactctctgattagattacattatatggctaaggtgaaggaattctgcagatgtaattaaggtcccagatgagttgatattgagttactcacaaaggagattatactggatggccctaccttaatcagggaaaagcccttaaaagaggactgggcctttcctgaaggaggacagtccactgctggctttgaagcagtaagcagctgtgttttaagggggcctatggaggggcccatgtggcaaggtcctgagggtggcctctaggagttggcagcagttcccagccactggctagcaagaaaacaggtggttcagccacatagccacaaggaaatgaattctaccaacaatccaaatgagcttggaagtggatattttccatggtcaagcctccagacgaacaccttaactgtaacatatgaacagctgagcagaggacctgcttcagccatgcctggactcctgacttgtggaaactgagataacaaatgtatattattttaagctggtaaggttgtggtaatttgttatgcaacaatgccgaatacagtaggcatcttaaatgtttgttgaacttaatttaatcagggaaatataatatttaaaaggaatcttttctaaagttttagccaatttaatgaatgtagatatcttaaagaattgccatcttcctttggatcttctagccatgcaatcgacttcacaaacttccaagttttcataaataccagcttctgattgtctggaaacaggaagtgagattctctccagccatcatttggcattcttgggagatagaatggataaaaattgatgttgaaatgagaccaccatcatttttcagtctgctcaccacgtacagagctcaggatgattagaaaatgtaaaacacatgtgagtggctcaaacccctttagttaaatcacatttacatagatcagttttcccaagggatataagttagctgaacttaagcaattaaaaaaaataaaactaaactaaaaccttttgctaaagccaaaaaacatggatgagttaaactgtatcagatggaatggtttgttttgaaaagtgtttggtttgttgtctatatacgtgcgtgcttttttaaaaggcagatagaaaagcagaacttacaagacctttagctgctgaggtggaaagccagtattacttctaccacagcagttgatatcatcggtctcaccagcaggtcacggatttgttgcttgctccctgtgacaatcttgaaccattgtagggaccttggcatatagagggacggtgaacagggctgaaaacaaaattgaactcaatcttgagcttggtattccaccgagagcaggttttctgggctttgaaataccgcctcagagagaccttccttgatattctgccatgttgagaacaagaacaaactttttggccctggaacctcttccctcccagtgccaacatgttcaatttcatttgcccttggctaaatgtagcttcctgtttctaagaaaagaagcagaaaggggcttttgaaggcctcacagacagtctcagaaggcttcatgggcagcagacaactcttagcaaacaacaatttgatgagttaagtgtaaacggctcagagacatatggattacattttttgggaaatacacatgggcttacaatgtaaaactgggtagtgtggggtggggtggagaagggaatgcttggaaaagtgtggtttgggtcttgctaattgcaaaatatttgaaacaaataatttgagatgttttgctcaacgtacagcgcggttggatttgccctttccatctatttacgtgtcattttcagattcggctcacataccaatactggtttgggtcttgagttgatttttaaaaatgcagttattttgaaaggtcatgccatgtgatttctgtgtagcctctgagcataaagggtggggtggtataggggaagaactgggcatttagaaacctctctgcctgtaggtcaaactgctgctcagctcttctggtatattctacttatggaggttccaaatccaggctgtgttagtaagatgcagcagcctcagtctccccacctgtaaaatggggacagtaatacttatcccagaacccatggcgattgggatgctgtgtggtgtggagttaaagtgtggaccctggaggcatatacctgtgcatatcccagctctgctgctgatgtgagcttgggcaagttcttcagcttccctgggcttttgtttcttcatctgtgtaatgaggaatatcttagcatccaccacatagggttaccttgagaattaaaagatttaacccagtccccggcacacaataagtgttcagcaaatgctaacagtggctcttgttgtttataatttatcttgttctattaagtatatgaatacagtagataataaggcaaattcacctccaggctggggagaggaatagccccttaccaaacagtgagggtctccttcagcttaccttctttttcttattgtttcaacctatggattaattacctagttttgtgaccccaaaataaaagggtagattccttgatctaaaattagactcatcttttccctatcctaggaaggatccgtttctctcttctattttaccactgtctagcacctggagacacttggtttaagagcccagctagtttatactagagtgtgagggaattctgagggctcaggtggaaggaaagcatgattccagagtgttgttgggttaatgcattgcttctcaacccttcctgcacattagaatgaattgagaagcatttcaaaaataatagaaatgttagtgtggggcttcggtattagtacattttttaactccccagctgcttctattgcgcagccaggactgagaaccaccctggctaaggcattcagtggcattgtaggtgcttccctgggtcgtttctgactcgccccttttaactcactggcccctcggactctgatttctgcccttcatgcagtgggagagctttcctctggggcttgccttgaggtctgcaggagcaaggccacttcctctctgaatcctagacacaggctttgggtcagtactcccacccacgtggagcccccttctgcccctctgctctgggggatcttgtctgaatccatcccttctttgcctgccttatgccttctagctactattcctctgcccttcctttcttgatcagcacaattctgctgctttaagtccttttttccattaaccattgactgccctttgctctgtcaaacatagttttggaggctgtgtagtgtagtgaaagaacagggaatttgaggttggacctgggtttaactctctccttgattgctgacaagttacttaacctctactcatttgtaaactaggaataatctgacctggatgagactgctgtgaagatgaaaagaggtaaaggaggggtgatggtgtggtagtggtggcctggtgagaatgacggtggtggagtgatggtgataatgagaatgatgataatggtaatggcggtgttgcggtgagggtgttgatgtggtggtagtgctgattttcgtggcaggtgatggctatagtgataggggtggtggtgatgatggtggtggtagttgtaatggtgactgtgatggtggtgttgatgatactggtgatagcagtaatggtagtgatgatggtaatgatggtgttaatgatggtggtttgatggtggtgaacatgacagtggaggtggttgtagtaatgatgataatgatttggtggtggtggtagttgtggtggtggtggtgatggtggcagtggtttagtggtaaaagttcagtcaagaaagaagaaagctggaggaaccaacagtattctgatcagaggaaccacatgggaagcattgacagagggtctttgcatttgctaaggccatgggagtagctggttgtatcagttagcatttgatcaggaaatcagagctactctgtatgacacggaataagggattaatcatagggattaaacttacccattatgaaaactagtaaaaaagtctaggcaaggctgttgcctctgtatctggtgttgggcttgacgtttctttgggtcagcagggcttacagatgggacagaaagtggatggaaaggggagagcaagaacaaactggaccatgtctctgactctcaccacctgcagtggtaacacagtgacctgcaggaaaagccaatgcctctcatctcaggcctggacatgcacctgggtcaggactctgggctggaggagacccagggagccggaggtactggagccctgctccatcaaggtgaggcagcaggtctgagatatatgtgagctgctgctgcgccgggtccctaattaaacctcctgagtggaatggctactgcttcccttctgccttccaatcttctcacagatttctcttgttgccagctttaatctggaaccatagaggaaggaactttgggaaatgtggttcctgcttagttctggtggcacagcacaagtcactgccgaggggtccccatgtggattggatgggttaaaagcttcagcacctgtagtggcctgtgcagtctacttgctctgacatttcaagcctggagaggcaagggggacaagagctgagctgagggccatgccagggaactggacaaggaaggccttggcactctcaagtcagggaatagcctcgccatttcatctcatccccagatgctggagtgcgttggtctcccttctaacctctaaccactgaaagggaccctctgtacaaccaatccttgactttggaatcatgggctgagtaaggctgaaacatttagccgtctttgggaccccagtatttccctagtctcactctagtgtctcttgaagtggctgtctttcaaggtgttgaccctactccctgtttctaacatctgcctgctacataatccagctggacttctcaggtatccctggtggctgaactccttagaccagggagctcccctagtgcctctagtgctgacaaagtgccactttgcaacagtttctgcccttttcccggttctctggcttctaaagccttcatttatccacagatagaaatacaatcaatcccatccttactctttcttttgacaattttcttcatcagatatacacttagaatttaactcaactgtgttctctcctattttgtcggtcactgctgtaacttacatggaatcatggttgggtggcagggactgaagtagttagttctcacttatttactgtgaaatgaatagtttgagattcggtcagtagtcagaatggtattcttcacttcctccttttctttatttactatgctacctggtttgtgaacattttctccagctgcaagcaatttacacaaactgtaaactctttatccattataatccctgtaactatgcctagagactggaaaatgaccagttgtcattacattcggaaaagcatagaaaggatctccttacttgtggccctacacctggtacttttcagatagtagatgagttattaggatgatttgcacctcagttttcttatctgtaaaatgggagggttgccttgcatttcatgctgtgttctttgatgccctgggggattgccggattgccagaggactcattgggaatttggggatggggaagagcatgtgtctagagggccttcatccctcattcaactagcaaaaagccacttattctgtgttatatatttggtttctatgagagattggattattggtcagcaataaaaatcactcccttccttcttcctcttggagcagaccgtaactcccctgttctactgactttgggcttggctatatgactaactttggccaatgaaatgtgggaggatgtgatgtgaatagaggctttaaatgtacttgcatggtttggcttacctcttgtactcttctgtttgctgtgagaatatgctgcagggagccactggtccaaggagaagaagaggggtgtagaacagacctaaacccaacctgtagcctgaaacagagccgagtccagcctagatccacttatagtcaacctgttgatctgttagcacaaaaacacatgctgccataagctgttgtgttttgttacacagctatagctgtctaattcagcttacaaataagttttgtccataatcatattttttggtttaaaaaagtttgaaaaccactgggtttgctgagttttcagctttcccatccacttctactgtcctgtttctttctctttgtgtatttaggaaagagagggagaaagaaagggttttggaaacaacacagtctggtagaaagaaagaaaggataatttttttcttttgaggaaagagggacttagggagctgggaggagagataggcacattcatagttaaagtatgttttgtttcttttttgaaccctcaagtaaacatttctccactgacattgttttgcactgttacattattttgttcactttagtgttccatttgtacaacctctgaaattccaggaagaaggtgaaagaataacattgcacatagccctgggttgtgctgtgtttacttcatgatggaccgttcacttgggcttaaccttaaactgacctttctgattccagacgagacagcaaagctttgctcacagattcaaaatcagggaacagaaacagctgacttccctggccaaggatgttttccattctcattatttttgtccgtggtcacaaatgagatgctagggaagtaatttttaggaattcctggagtactttacttctgatgtgcatgcacagataccctggggtcttatgcaattggtaccccaccccaaagtctggatatattcgttgtaggatgaagagagggaggaaggaaggaggactgaggaaggtcttaggctattttcaagctcttttttgctccgcactttgcaacatggttttattttattcttataagttttgagatcatctcaaatataaatacaaaaccattgatcaaaggccaagaataagaaatatttagatgccctctattgcagtgaaaaagcaaatggttgctatatcatgcgtaaaggtaatctcttcaaggattagcactttaggtcagatcatggaagcctggttttgtttctcagaaagagtgtctttctggggcttgggaggccaacacgaggcaggctgagctttgtctatggcaggagctgagtttgagtctatctctgccattagcctgtgctcaggttgtgtccctacactgatggccatcagaatttgggtatcaagtgattcgcttgcttgtactagattgagctcctttgaggacaacaggagccattaatattttagagccagaggccaggcatggtggctcacgcctgtaatcccagcactttgggaggctgaggcgggcggatcacaaggtcaggagatcgagaccatcctggctaacatggtgaaaccccatttctatgaaaaatacaaaaaattaactgggtgtggtggtgtgcacctgtaatcccagctacttggggggctgaggtgggagaatcacttgaatccgggagacagaggttgtagtgagctgagatcacaccattgcattccagcctgggcgacagagcgagattccatctcaaaaaaaaaagaacttagaatctggactggtataagccttaattcaaatgccatctttgccctgtacaaactgtgtgaccttgggcaaataaccagttctttgtttcttcacctgtaaaatggggataattagtacttttctcatagggatgctgtgaagagtcaaagatataatggttgtagagtgctcatcacagagcctggcatgttgtatctgctcatatatgttagctatcaccatcattgctgctgctgctgtttttattaatctagtcctgggaatttatatcatggaaaaaagccaaaaaagttatatgcttaaaaatgtgtattgcatcttgtctatagcaatgagaaattagaaacaatctaagtgcctcattcattcagtcaatttaacaaatattttttgaagtcctattatatgccaggcactgtatcccactgtttggggtacatcactgaataagagagacaaagatccctgcttttgtgatggagaatgggtagctaaactatgggacaataattcaatggaatgttatacagctattaaagcaatagcaatgaagacatgggaagttgtttgtcgtgtcatgtaaaatcaaaaagcagaagaggaaaacatagatgccttaaaatatatgtgtgggtggacagagactagaatggagcatttaaaaatgcaagtggttgttagagtgatggaatcatgttttttgtttttcagtaatgtttgaagtggttttacaacattatggaaaaaatacatatatatgcataaataattgagaaaaatgaactggccctaagagaagtttcttatggtttaggaatcaaagtaaggcttataggcagaagaggaaattgcctaggtagcaaggaaggaaaaattgctatttcaaaccaaaaatgactgttgcagttccactgtgcactggaagcatggaattcatgccaaggatgttagttctttgttaaggaaaacctgttaagcagatgagtaaaagaggccctgaagcctctggagagaggagagttcagacttaaacgtctttgtataataaagtaacagaagatttccattttccctcagcagtttggggatggaagggagaaatagagattcagaggctggagaactgggagaagatgagtaaaggaaagagccagctaaagaggttggaagagatgaggccacaatagcaacttgaagaacactgataactaatactcaattttaagagattccctgtcccaggagaccatatgtctccccactcttaccttccctcaggagtctccaagagggcactgtacccccatgggataggggttgttatggtttggatgtccccaccctaatctcctgttgaatgtaatccctaatgttggaggtgggacctggtggaaggtgttgggatcaggggggtggatccctcatgaatggcttgggccatccccttggtgataagtgagctctggctctgagttcacagaagatctggccatttaatagtgtgtgacacctgcccccacccctctctgtcttgctcctggtttcaccatgtgatgtgcaagctcccactttgccttctgccatgagtaaaagctccctgagggctccctagaagccaagcagatgctggcaccatgcttcctgtacagcttgcagcactgtgagcctgaaacttttctttataaattactgactttcaggtatttatagcaatgcaagaatgacctaacacaggggcttgggtcattttgtttggttattaaaagaaggctgatgtcatagaatattcagggttcacctacacaggggggatctgaggggtcagaagctacctgtttcaaattgactgcttttggggcctgaaatggcttcattgccaccactagcaatatgatcttttgcaaatagacaatctaggatccctgattttttaggtgcagcaaggtctgggagaagtgttgctcttccatgaagaccttaaggagaatgattctgacagatcattgatcttctgaggcaggaggctgagcaggtttttattaatgggtggagaagggaacagtgagcacacaggagagtgatactggggcttggagactgggaggcgggaggcaggtggtgggaggaagccttctgcagcccaaagtctcttaggacaactggggagtggtctctagactctgaatcctgctcccaggagaccctgtggctatgccccttttgggaatggtacttaacttaaaggcctgtagaataacaaccttgtatggccttggaaaaccaaggtgggggtggggaggagctgtctgccccaggtgcaggctacatttaaaaatgctaataaaataaagtaaaacaaactgctttttattatcaccatgtgccaacagtcagtgataaactacccctccctcctggggcagatggtttgggccgtccgcatcccctagtctggccaggctgtgggatggcaaacagccaaagtaggggatccagaaggagcacgtgcaggaagaaaacccagattcctcacactggtaaataagaggcttctcaggactgaacttgaaaaacatgagccccaccaagggcgggacaagaaaatcctcagaagacggctgagcagaggttaagcaaacatcggtgccaagccagtggcagctcggaaatgaaagcccagagatgtgatgatttttaagagttgaactgagctgcaagcttgtggatcatgtaagtgctaacagaggcagacggagaaggaagatctgtcatgaagtgctacggtgggaggtgcgtcagcttggggtggaggggtcccaggtggccccaggagaagaggcctctgaacaaagaagacaatgcttgggttacggtggaagggacacggaagggtctggaatgctggaaggagccaagagcagatgccatcttggtgatgtgtttcatcttcaggacctgagacccatctggtcaaatatttgtgtgtatatgcaaaattttaggtcatttgttaaaaggagctcatgaatacatgtccttgacttcccagagatggaaaaaacacttctctccgccaaagaacttccaaatagtgcttctagcctatgctcctcatcagtgtccatgtctctcagatgtctctagttttggttgaggaatgaggaaatgtggttgcctccttttattggctgattcgtctgctgagctcctaacttcttagctaatctaggtgaaaccaacccttgtcctggaccctgggcttttgtggaggactgtcttactgttcacaaatactccgccttttccatgagaagctaatttatccctgcctgttgaaattgggcatggacaatgacttgcttggttgtctaataaaatgtgagcagaaaggatatgcgtcacttctgagccaaaagttttcagagccagtgcatggttggccatgttttctcttgcctttgtaggcacacaataaatgtttgttgaaaaaagatgaataaaaggaaagagccccaattaggagctgggttagctgaggcctattcccagagtttccactaactagctgtggcataatcatttggctactctactggccataaatggttctttgttattttgaaatggagtctcgctctgtcacccaggctggaatgcagtggcaaagcctctgctcactgcaacctccacctcctgggttcaagcgattctcctgcctcagcctcccaagtagctgggattataggtgcacaccgacacacctggctaatttttatatttttagtagagacggtgtttcaccatattggccaggctggtcttgaactcctgatctcaagtgatctgtcagccttgggctcccaaagtgcataaatggttcttaagatttctttttttttttttttttgagatgggggagggtcttgctatgttgcccaggctagtcttgcactgttgggttcaggccatactcctgcctcagccttggagtagttgggattatagacgtgagccaccatgcccagctcaggattctttcatttctaaaaccctgtgcagatattgcagaagtaaagtgatgatttttggatgcttattggaagtcttgttcatgctggtgaatggggaaaagactttgggtgggggtagggagcactgattggcaagttattttgtgtttttaaaacaaaaatcgctcttcagggtggtgcactattcccagattttctctggaagctgtgttccaacacctttctcagacttccccacactccccctcaggacatcagaaggagggcccccgaattcattcttgcagcaaagagcctcaagactctgctcagaccaggaaatgagggacctgttcctacaaattgctgtcaaaatgtattcttaatatttgttctctggagtcactgttttggtgacctcagtccctggaggctcctcctgggggcgataggatgccttcagaggggagctgacagccctgtgttgtgtctgggctcgcgggaggccatcgctgtgtccattggagccagatgttttcccagcccttaacctgctgtggtttcttagctcaacgtctccagtgcgactctcccataacacccagcgccatcttgtagacgcgctcatgcttccggaccgcgggcgccccaccgggaagagcgctccacgctgaagaggaaggaaacttcacacttaattcatcaaattcaaactgagctgtggtgaaaggaacggggcagagtgaaaggaacacccatatgccccagaagaccccggggcatcgctgcctttcagcttcttttgcgctttctgcagctcgtgtcacattccaaggacactcagctccgcacatgcacagagggccgcgtctgtcccgggggcgtgttacctaaaaccaggcgctgacctccaggtcaggaactcttgagtatttaatctctccgccgttcatggctacccgggtggcctctgaaatattacttaatgtctctgggttctgatttcctcaattgtgtggtacccagtgaccttacgatgacatttcactacctacgaaaaatggcgccatctgaatgtttagtctttacctagaagtataagaaggggtttcttgcctgggaatgatcctgtgaagctgaggtcacagtttatcttctcaattagggcagggattagtacaacagaaggtcattcgtcaagaaaaaggaaagcttctccctttccaaaaatgcaagtagtgaaacttacatttctcacttttccctgattgctcagaactaaatataaaatttaattggcaagtattttagcacttatttttaacatattttcttttggtcataatttttaattttattaaccttactgatttgacagggtcaaatctaaataaataataatattttatttattatacaatacataaatttctgcatagcttgaagggaccttgtggattgttaaatccaactatgtagtttacagattaagcagttaaagtctgcagagaagggacaggactaaatgtcatcagcttgttagttccaaagctgggtgggaaaagcagttcttccttctgattcttagaccaataattcattcctccattccataatgacgattcttagaacgtgaccttacctgtaacagtagggacaaagcaagacaattgtctttgagtttcaggaacagactttttagaattaaatagtttcaggtacatgctatagggaattcagttgatttgtcctggttagaaagcactttgttcacacctatacatatgactctaggttatgggttcttctggagtcttctgaacctgctgggcatttctgactggatgaaaattaacaaaagtctatgttcatcctgatgaaaattagcagcagttcatcttagtttaattgccacaacgtgcagctatgagagtatgtatattttcattcacgtatttgaaatatttatggattgtctgttatatgactagtactaggggttctataaatttacccatataatgtgtatgtgttaaatatatattattaatatgggtaaatgtaatatgtttatataggtaaatgtaatctatttggtatgtagatacacaaatttagagtatataacagatatgtttctgtatagacatatattttggagacattctgttgtctggcttctttatattcccatatgtgctcaatttctgtattccctttcctgattcatcgttttcttctagtattgaagtagaataaaggcaaccatgtattgtggagcagggggtacacaacacaattttcaaggactcatttctacctctacagccatgcacagcagccttgcagttcaaatcacgaagctaccacccatctgatgacattttgctgtcctaatcggaaagggtagctttagacaaaatgaaccatcttttgagggctgaacttgcaaatatgttcgtgtgtgtgtgtgtgtgtgtgt

SEQ ID NO: 1005 - DNA, 787 bp, Homo sapiens
tgctgaaaggaaagatggccaaaggaaggaaagtggccccagaccctgccgtcgtgaggaagcaggaggctaagaaagtgatgaaaccgctgtgtgagaaaaggcctaagagttttcttaggcaggcattggacaggacatccagcccaaaagggacctccgctgctttgtgaaatggccccgctatatctggttccagctgcaaagagctatcctctataagcagctgaaagtgccttctgccattaaccagttcacccaagccttagacccccaaacagctactcagccacttaagctgatccacaagtactgaccagagacaaagcaagagaagaagcagagactgttggcccaggctgagaagaaagctgctagcaaaggggttgtccccactaggaaatcacctgttctttgagcaggggttaacactatcaccaccttgctggaaaagaagaaggctcagctggtattgcacatggtgtggaccccatcaagctggttaactttctgtctgtcctgtgtcctaaaatggggggtcccttaatgcattatcaaggggtaagaaggcaagactgggacatccagtccacaggaagcaccactgtggccttcacacaagttaaccaggaagacaaaggagctttggctaagctggtggaagctatcaggacaaattacaatgacggatatgatgagatctgcaatgtcccgagtccaaaatctgtggctcacaatgccaagctggaaatagcaaaggcagaggaacttgccactaaactgggtt

SEQ ID NO: 1006 - DNA, 7063 bp, Homo sapiens
gtaaaaacttaaggtcttattcaggtcattactgggcctttgtctttccctaggcaggtatgttggctttctaaattctctcacatatgcaattactttttagtctccaaaaacaggtgtatcccttttgaatcccttggtggctacttcagtttatggaggttggataactggtgaccagcctacatgcccacaccacatttatcagagaagcactccataattagaacacagagccctggtgtttggaaggccaggtctttattgtctaccctggctccagcaagacctttcacccttgaatgtgggttatggaccccaatgccacatgacatgagactatagagactgtggttgggggatggtagttgcaaccctgctcgtggcttaaataaagcaaagattaccataatgtaccagccaagctgtcccctggaagctgcaagtgttcaaaataaactacggaggtttaaaatgtttgcctcagccaatttcttccaatataattgtgcagatagagatggatttttggtattttgtactttgccatttgtcttgacttcattctcctaaggatcagttttaatagtgaagcataattactctttgaagcatgttagttttcctgtattggaagtcctaatttgttcctcttttgttaaatttaaaatgtgtatgactcattatattggcatcctgaaataaataactctttgtaatccagacattttgattaatcagaaaattacactaacatcctagtcaattaaatgtctatgcagcactgtggtcccactttgcagagtgactataattgccttgctttgccattagtaattgttctagagtgtgaaataattgtaagtgtatgaaagctcttgtagagagaacttcacctaggcttgtggcattcactattaaagcaatgagtgccttctggggacagtcagctcaactgacttcaaatttttgcagagtgtcatcacaaacactaagtatagatttcagtttgaaaaactttaaatttaccttttattgcagtgtttggtggtataaatgcagctaaaagcatgagttaacaaagtgagatttagaaaggaaatgtcattgactgcctgagctatgtacttcatggaatatgtttttgtaataaagcccctagaaaatcgggaaacttatgaaacaagctttacatatgtatatgcatacatatatgtttaaaacttatattggactaaggttagaatacttagtgaggtctaaaatgacaaatggggtgtgagaatgtaagcaaagtaaacaaggactgtcagttcttaatttattagcagcacatgctcaccaggaacccgttgtcttaaagccaatcccctgagaacaaacagcattgagtctgaaattcaaatttcccagaatggaaaatgatgagccctagaattttagagtcttgtcattaaatttgcaaagttcagttacaccacagcccagctacttaccaagtgccttattactcttctctttgggcctacttaacccaactaaagaatcagggagtcagactaaatatccataaaggtcctcctaaagacacatcctctggttcattttgaatatctaacttaacattctgtccctgcaggtgttcttttttatagcatcattttagagctgtagcctatctgcagaggaagagctacaggcaggtttggagtgcatgagttcattacaaataccgtgttttataaattgatgccagtgttcttgacctgtcttgtgaacaactgggaccttatttcctgtgtcactctctcccctttgcatcttaacactttcagctagtcttagaggtttccattgagttctgaggacagactttcagaatcctcattctcttgcttcctttcctccagagatatttctgttcattattgtccttattatgtgttttttttttctgattatgaggcaactaaaatcatctgattattgatcactgtgttgaacctctaactgtatttcttcaatggtttgatatatttttcctttttttgagatgaattctcattctgttgccaggctggagtgcagtggcatgatctcagctcactgcaacctccgcctcctgggttcaagtgattctcctgcctcagcctcctgagtagctgggactacaggaacgtgccaccatgcccagctaatttttgtatttttagtagagacgatgtttcaccatgttggccaggatggtctggatctcttgacctcatgatctgcccacctcggcctcccaaaatgctgggattataggtgtacaccaccgcacccagctgacatatttttcatagttaatattgctagtcagtatgagtttttaaatgtgcatatttcgtttactatttttcttccttcaagcctctgaaaatattgatggtgtctcaaaattaataatttattgattgaaaaaattccattgatctattcatatttatttataacgtaccaaatctagtgcaataagtagtcccaggaatttggttcccatttgggagttatacttgaatttcatttataaacccaatttctctcctctggcacatgtattcataatcatcttagcatgcttttagttgttacagatgaggtaactgcagtttgatgtttactctacactctttttcacctgcaaatgttagctagagctgcgtggtcctataagtttgctgtacccttgataaaagaacttacattttataatcattgctatggctgtactggatcgtggatccataactctacaggtttgtcaaacactaccaaatgctacaccacaaacactgatctttattctttgcttattaaaacaagcaaccaaccaggttaatgtattccaagaggaaaaagaaattgaccaaactaactttggaaaatggtaatttgactgcataaggtttacacaaactgagctgtgtgtaaacacggtatctagttggtaattttatcacagggacaaaagttaattctgacattacttttcattttcatttacactaggctagagaaaatgaataagttgtagagaatgtgagctagattcctcactgttacagaaggaagttataagttagaaagggtacaagactagaaaaaatcctgtggtgccagattagagttaaaaatatcaatatatacgcagatagatatgtagataagatagactcacagagagatggtagttaggcagatagatagatagacagatacatatacatagagattgatagatgatgtatatacatgggttaggacacactattgcttgttctgtctgctaagagatacatgcatcccgtaagcaatgagcataaatcttggtttctaaataacattctccaatataatgattcagatctctggagcaatgtttgcttctaggactggggcagtgaaaacataagatgatcctggagcatcctgatgtgccagcaggccagaaagtgctcaaaacacaaggatgtggcatgcgtcgtaatccaaagtaaaatataaagagacgtgagtccatactatgcaaatacattgttaattaaatgaatgagaaggaagagactaatctttcccatggaagaatttcaaataatttatgtagaaaacatgagggcaaagaaaatcaccattagaacactatagtgatagtggctgttggcaagatccaatgagggacccatattagtgggtgaaacttgaggaggaaacagggtatttgcaaagcctgaaagtatctttaaccgaatatttactaattaccatggttgttttaatatacactcacaaatatattgttatttctgccttaaagaggtggagtttaattttcctctccttaagtgtgggctggatttagtgactcaattttaacatatagaggatggaagggaaaaataacctcgcagaggagcaacctggcagacacaagctaaaccgagtgattgcggttcatgtcaccagtgatgccttatccccataggatgtgatgaaaaggccacctcacctctgcaacattcttccctcaaatccataatcctagtctagtcagacaaacataaaccaagggaactccacacatatccaactggttttcagcaaaagtgccaaggtcatgaaaaacagaaaagattgagacactgtcacagagtcaaagacactaacacatcatgatgagcaaacatggcacagtaccctgtattggatcctggaaccaataataataatagaaaagtggcaaaatccaaatgaattgtatagtctacttatagtattataccaatgttaattcttcttagtgttgttaaatatattatagttacatgagatgttaaccttaggggaagttaaaggcatattgaaaccatccacactatctctggaactcttctcaaaatctaaaattacttcaaaataaaaattttttaaatcaggaaagaggctaaagcgggctgggtgtggtggctcatgcctgtaatcccagcactttgggaggtggaggtgggcagatcactctagcccaggagtttgagaccagcctggccaatgtagtgaagccctgtctctactaaaaatacaaaaagtaaccgggcatagtggtgagtgcctataatcccagctactttggagggtgaggccggagaattgcttgaacccaggaggtggaggttgcagtgagctgaggttgcgccactacactccagcctgggtgagagaaaaataaaagaggctaaagcatcaaaagggggagcagggaagcagggctctcttttgtcttaataaggaagtctgagaagttctggcaccattgtcatatgtttctagcagagcagaatgccagggctgggccatgtctggggaacagcctcaggatagagtagacagcatataagggaactgaggccagaccccaggaagaacaaaaaatatatatttatgcagagagaacaatataaacaagcttctactgctctgatgataaatgtgagatgattcacaggacactaattcatatctactcttaccatcagaaaatataaacactattaaaacaaaatgtttacatagatccaagcttatattgtgaaaatagaacttctcattgttctctacatgggggtgtgtacaacactggtggaccccgcaagcttgctcaggtacaactcaggtacaggatcatttgggaaccctgagcatggcccctgagccaatgtataacatgattggtcaggctggttctgccttgaataacacagattccactttagctgagagaaggtaatatttttttaaattccattttggtttatctacactgttttagaatgtatgggtttctctagatcctctgttacttcaggtgtgacattttatgcacgtcacttgttgcagcccactggtgtccacattctgccatgtgatgtggaggatcctcacctccatgtaggcccatttctccttctcactttacaacataatttacatgcatgaagaactatatcagaccatggagtaatttttgcttcaatcatcaaacacagtttagaaaaactcaagaaggccagtctgtcgtgtttatccatgtttttattatttctatttttcttcattcctgatgttatgtttccttattttatcattttgtttctgaattaagaacttccattagccacacctttaagaaggttgctgtgtccttccttgagtcccaggtccccctggcagcccacagtgtggatctgggatacacagggtgagcacaggctgtaggagttcttgaaattctggcaggggttctgcacttgacctaagaggtaaggcaccagcacttctgaaaccagacagaattggatggaagctgtattttaaggtgattgtctgtatttatgaggattaatcttttggataatctggaaggcctgggggactcactggaaagatatggtaataatttcaataaatatttaagggctataccaagttgaggctggtaggaccagggagaagcagctgcatgctacatattgagatcatctaaagacagcaaattgatgttttacatgaggttgattttgaagagtaaggaggcatatctggtccccagtctcatctctggaaagaactgcaccagacccaatccaccctaattacctgttctctcctgattgtgaagtctatgaaaagaaacacataggtcattttcagaaaatgaagacatggtgttagtagcaaaatctcactgtggtgtgaatgagcatttatgaactgtcaggaaggagcccttcattgctctgttgtcaagaatggcagacactaagagctcagccagggctttgacttaagctccatgtgaataaccttggcctatgctccctggacatgcagttcactgtccgcagagtgtggccagtttgtctgatgggaggaatcacatgcactgtgagtcaccccttgcagcaagaagtccacaaacaggactttttcctggcaatagtaagtgaggtcagctggggtgtggagctgcccaagactggctgcacactccagggatgggagttttagtgccctggagggagcctccacctgtgactgctttagcactgccctgagaaccatggtccacatggcgcctgtgagcagagatgggggaaagaggagacatcactgggctgcagaggtcaacagggttgtggaagtgtcttttattgcaattaagttttctagtcatgaaacctcttcgaggtatagaatcagctctgaaattctcaaagtgttttgatcatagtatttaaggatttatttttttaactgagatttacattactatgtatttgcagtaatgtttttgttaaaagttgtatcgtaatgtatttagccagaacttagtgtctgtgagaaagaaaagatactagaacttcttactaccttctaagatataaagtttaaaattatataatgtaaccagtgacttccctgttttaaaaaatcacatactcaaaaaaataaacttactgtctgtata

SEQ ID NO: 1007 - DNA, 3311 bp, Homo sapiens
gacccaacaccaggccatgggggctactaagtctggcggagtcaaaggaacgagaaaagacaagttaaaagagaaagtgggaccatgcagccaatgctagtgtggaggctgcaaaggccctgagctctgggatcccacactatttattgatgatcaaacaaagaaacaggcagtgaagatgtgggggttgaaaggaagcggtgtatcaagtgaatgagctacagctgtgacggtttagcattttctttgaaacatacggctacttgagataaagggagtgctagaagcaaggagccagcaagtctagacacattccaaagaccacgaggggttttaatcctagaccctggacgtgttccaagccctgcctcagcttctctcccaacactcagcttttctcccaacactcaacattggccattgagagccccttcagctggttgcagtgtttgataagcaagatctacatcatggaggtgatgacatcagtgccagctccatgcatacccagagcccggagagatttactagtgctagtgagcttggcaccaacaatgtctcagcctttcagtctgatcaagcagcaagtgaaattgaggtcacatcttcagtacttcatgcaaatatacctttggagcccaacccttctgaccatccaaaggcaagcacaatattcctgagaaaatctcaaacagatggtatctactgagcattttactcaacaatacagttcatgttcgacaatattccttgatgacagcatagccagccagcctcatcttacaatgacactaaaatctgtgaccttggcactatattatcatatcaagcaaagcgaaaagaggttttggaggaatattttaagtatgatcctgaacacaaattgatcttcagatttgttcgtactctgtttaaagccatgaggctaacagctgagtttgcaatcgtaagtttgatttacatagaaagacttgtaagttatgctgatatcgacatttgtccaactaactggaagaggattgtcttgggagccattcttcttgcctccaaggtttggagtgatatggctgtgtggaatgaggactactgcaagctctttaagaacattacagttgaagaaatgaatgagttggaaaggcaattcttgaagctaattaattataataacagcattactaacagtgtttatagcagattctacttcgatcttcgcaccttggcacacaacaacggcctgtattcaccagtttatcttcttgacagagaaagagcttggaagctggaggctttttcaaggatggaacaagacaaagttttctacagtgctgccaagaatgggtctctgagtgcagatgatttaattcatcttcagcgtgctaaggccatcctcttctgaaggaagaaatgaggagtaatttaacatctgaacccctcatcaaaaaagacaggaaaatatcacctctcctgctaaagaactagaaaagttggtattttctaaagaagaaacacctcaattcaagttaactcaaggacaactaagattgcacttcgtagtaaagaatgggaccttgtcagggcaacaacacactcttacactcttctgtcctgtttaatgtaaacagagttataaaaaccacttcaaagtgaagactcctgcccacgtacagatatttgcttaatgtgtgggctgatagctgtgaactatgtaaggcttttaaaacaatagtttaactttttagattttaaagataacttttctgtttcttttatgtttttttcttttccccaatattcctgcatatgcatttggaatcagtgcagtatcactgttaaaacatgggagtctaacaactcctaaagccactaggagcagtcccagcattgtcaggtatggaagggctctttcttcctacttttaccatggaagctacagttactggcgatcatcaagcaaaagctgccaattaacatttgccattcgtatcctttgtaagcccttcttattagcagtttagcatgtttgggggtcataaaaagagaaagtattggttattgattatctacttttatgaagctctatggtgtatttcttatgaactataatggttctcatttgctgataaattttcttattaagtaaatgtattcaaagatgttttcatagtgccaagcagcatggtggtccagtggttatataaaaataataaaatacaaggtgtcctgaaagtttcagggcagtttttagctttaatatagtgtgcctgggccctccagaggactgcagcatatgtatacatgctgtaaatctttacaaaatatcatttgaaagtgtaattgtatttcttctttttatttttaatagatgatgcctcactatattgcccaagctacagtgcaatgattaatcagagacacaatcatagcacaccacagcctgaaaatcctggcctcaagcaatgttcccatgtcagcctaccaagtagctgggaccatgggtgtgtaccactgcctctggctttattttgcagaatttgaatgttaaacttttaaccttttgtttcagtcaatatctgctatcttcaagaaggactgaaacaataaattaaaagcttaatactcaggagctaggcatgcttgtagtcccagctactcatgaggcttaaatggaggatcacttgaggcctagccttggaggctgcagtgcactgtgattgtgcctgtaaatagctattgcactccagccttggcaacataatgagacactgtcactttaaaaaatggcaaaactaaataaacgtaaaagaaatacaacaagcttttcaatgatttgtaaatgtttgtagcattgttacttctacaagtatcaaagcttaaaatttcactaagacttttggaattcttgtgtttttataaagtgcccttttctcttgtaaagtagctctttgcaaggcttttatctgcattgatcacctcagattattttccctagatgtgataaagaggaggatccatgttaattcatatgtaacaaattagaaggaattggaccctaatagtagtaggtgatgcaatacattttattatcccacatgttagcctggatgcaggtatcatatttcatgtcctgctatttaaaaagaacttccataaaccttaggaatcctacctcctgaaaaagtatcatttatggaatgcagagcttagagattggagtattgattgcagttttattttcaaaataaatgctacaattgatgtggttttcatttctcatgtttatattaaaagaaaacctagtaaactaattaaaa

SEQ ID NO: 1008 - DNA, 2040 bp, Homo sapiens
acgcgcgcggggcaacctcgtctcgcctcccggcccgacggagccctcgcctcaccttttccagcagctccgccgccggcccgtcgtcctcctcgcctccggtcccattcgccgccgcagccgcctcggcctgacagtcgcccgtaggggagaactgaggtcgcttgaagcgcttcgtccggctcttgcccatggtgacgtgcgctgggcggacagaccaccgagagaggagggcaacagcaggcggtggaggctgccgcgccgttaacaaggtccgttgctgctgctcagctgggccggctgacggctgcagcacacatgggcaagccgtgcgcaggcgcacggcgcgtcgtctgccgggtcggggttggggcggggcggggtggggggaactggcgcacggagcgcgcaggcgtggaagagggcataggcggggccagcttcggcaaaggggcggagccttgtgggtttaccgggtaagtaggaggttggactagaatagtaacgccgacccgggcgagaggatcacttgaggccagaagttcgagaccatcttgggcaacataggaaaacactccactccctgtcctccccaccaaaaaaattaaaaattatctgggcatagtggcgtgtgtgtgtagtcccagctacttgggacgttgaagccggaggatcacttgaccccaggagtttgaggctgaggtgagccgtgatcctgctactgcactccatcctgggcgacagagcgagaccctgtctcaatcaatcaatcaagcaaccaataagttagtaacaccggctacaaataatcaaatgtgattaagaatacctaacttgcaaggttattgtaagttctgtaaagttcataaagttctgtaaagtgcctaacaccaagcctgatatatagcaggtactcaaaaagcattaaccacgattttattttgtgtccccagcacctcccatagctcctgtcgtagacagagactagttaatgttttggaacgaatgtgtgtctatatttgataaaacagaatcgcttaagaacctaatctccctgccttagtttcctcatcagtgaagtggggacatcgatagtatatacctcatggagttgttacgaagactaaatgtgttcatatgtttaaggtgctaagaacagagactggcagatactaagcactatgtaaatgtttggaaacgtatttaacaaagagattcttttgcagatatttgttgagtactaggtacagtgctgggcattggaataaagcagtaatcaagacagtttggttcctgtcctctctccctgtccttatggaatttacagtccagggagagatctgttgaatatataattatatgaataactttggttataattgtggtaaatactaagcagagggaaaagtacaggagaatcttaggtggtctttataattagacatgtaacgagtgagtactcaatatatgcatagctttgggtcaattttctttttttctttttgtttttgaaacagagtctcactctgctgtccaggctggagtgcaatggtgcgatctcggcttattgtaacctctgccttggagttcaagcagtcctcctgccttagcctcctaagtagctgagattacaggtatgtgccaccatgcccagctattttttttttattattatttttaggagagacggggttttaccacgttggtcaggctggtctcgaactcttgatctcaaatgatctgcctgcctcagcctcccaaagtgctagtattacaggtatgagccaccacgcccaggctcaggtcaacattctactggagaaaatttccattccatggtaaccctactgtcaaagagttgactgtccagtaagggaaattaattactatggcaaattttagagagtaacagaagtgtagctcatgttgcatttgggcctatcaaagatcaatcttgggctgggcactgtggctcacacctgtaatcccaccactttgggaagccaaggtgagcagatcacctgaggtctggagttcaag

SEQ ID NO: 1009 - RNA, 22 nt, Homo sapiens
ugagguaguagguuguauaguu

SEQ ID NO: 1010 - RNA, 22 nt, Homo sapiens
ugagguaguagguugugugguu

SEQ ID NO: 1011 - RNA, 22 nt, Homo sapiens
ugagguaguagguuguaugguu

SEQ ID NO: 1012 - RNA, 22 nt, Homo sapiens
cuauacgaccugcugccuuucu

SEQ ID NO: 1013 - RNA, 22 nt, Homo sapiens
agagguaguagguugcauaguu

SEQ ID NO: 1014 - RNA, 22 nt, Homo sapiens
ugagguaggagguuguauaguu

SEQ ID NO: 1015 - RNA, 22 nt, Homo sapiens
ugagguaguagauuguauaguu

SEQ ID NO: 1016 - RNA, 22 nt, Homo sapiens
ugagguaguaguuuguacaguu

SEQ ID NO: 1017 - RNA, 22 nt, Homo sapiens
ugagguaguaguuugugcuguu

SEQ ID NO: 1018 - RNA, 22 nt, Homo sapiens
aacccguagauccgaacuugug

SEQ ID NO: 1019 - RNA, 21 nt, Homo sapiens
uacaguacugugauaacugaa

SEQ ID NO: 1020 - RNA, 23 nt, Homo sapiens
agcuucuuuacagugcugccuug

SEQ ID NO: 1021 - RNA, 23 nt, Homo sapiens
agcagcauuguacagggcuauga

SEQ ID NO: 1022 - RNA, 23 nt, Homo sapiens
aaaagugcuuacagugcagguag

SEQ ID NO: 1023 - RNA, 22 nt, Homo sapiens
ccgcacuguggguacuugcugc

SEQ ID NO: 1024 - RNA, 21 nt, Homo sapiens
uaaagugcugacagugcagau

SEQ ID NO: 1025 - RNA, 23 nt, Homo sapiens
agcagcauuguacagggcuauca

SEQ ID NO: 1026 - RNA, 23 nt, Homo sapiens
uacccuguagauccgaauuugug

SEQ ID NO: 1027 - RNA, 23 nt, Homo sapiens
uacccuguagaaccgaauuugug

SEQ ID NO: 1028 - RNA, 21 nt, Homo sapiens
gugccagcugcagugggggag

SEQ ID NO: 1029 - RNA, 21 nt, Homo sapiens
uggcagggaggcugggagggg

SEQ ID NO: 1030 - RNA, 22 nt, Homo sapiens
ugagccccugugccgcccccag

SEQ ID NO: 1031 - RNA, 22 nt, Homo sapiens
guggguacggcccagugggggg

SEQ ID NO: 1032 - RNA, 22 nt, Homo sapiens
uggagugugacaaugguguuug

SEQ ID NO: 1033 - RNA, 20 nt, Homo sapiens
ucacaccugccucgcccccc

SEQ ID NO: 1034 - RNA, 23 nt, Homo sapiens
cucucaccacugcccucccacag

SEQ ID NO: 1035 - RNA, 20 nt, Homo sapiens
ugagcccuguccucccgcag

SEQ ID NO: 1036 - RNA, 22 nt, Homo sapiens
ucggccugaccacccaccccac

SEQ ID NO: 1037 - RNA, 21 nt, Homo sapiens
cgggggcggggccgaagcgcg

SEQ ID NO: 1038 - RNA, 26 nt, Homo sapiens
aaguaguugguuuguaugagaugguu

SEQ ID NO: 1039 - RNA, 24 nt, Homo sapiens
ccccgggaacgucgagacuggagc

SEQ ID NO: 1040 - RNA, 24 nt, Homo sapiens
aggagggaggagaugggccaaguu

SEQ ID NO: 1041 - RNA, 24 nt, Homo sapiens
agccuggaagcuggagccugcagu

SEQ ID NO: 1042 - RNA, 22 nt, Homo sapiens
aaccacuuucuuugcucaucca

SEQ ID NO: 1043 - RNA, 24 nt, Homo sapiens
ucccugagacccuuuaaccuguga

SEQ ID NO: 1044 - RNA, 22 nt, Homo sapiens
ucccugagacccuaacuuguga

SEQ ID NO: 1045 - RNA, 22 nt, Homo sapiens
ucguaccgugaguaauaaugcg

SEQ ID NO: 1046 - RNA, 21 nt, Homo sapiens
cauuauuacuuuugguacgcg

SEQ ID NO: 1047 - RNA, 25 nt, Homo sapiens
gggcgacaaagcaagacucuuucuu

SEQ ID NO: 1048 - RNA, 22 nt, Homo sapiens
ggcgacaaaacgagacccuguc

SEQ ID NO: 1049 - RNA, 25 nt, Homo sapiens
gaacccaugagguugaggcugcagu

SEQ ID NO: 1050 - RNA, 22 nt, Homo sapiens
uugcuugaacccaggaagugga

SEQ ID NO: 1051 - RNA, 22 nt, Homo sapiens
ggugguugaggcugcaguaagu

SEQ ID NO: 1052 - RNA, 21 nt, Homo sapiens
cugggaggucaaggcugcagu

SEQ ID NO: 1053 - RNA, 17 nt, Homo sapiens
gugggggagaggcuguc

SEQ ID NO: 1054 - RNA, 21 nt, Homo sapiens
ucacagugaaccggucucuuu

SEQ ID NO: 1055 - RNA, 21 nt, Homo sapiens
gaucucacuuuguugcccagg

SEQ ID NO: 1056 - RNA, 22 nt, Homo sapiens
ugcuggaucagugguucgaguc

SEQ ID NO: 1057 - RNA, 19 nt, Homo sapiens
uggauuuuuggaucaggga

SEQ ID NO: 1058 - RNA, 24 nt, Homo sapiens
uggcccugacugaagaccagcagu

SEQ ID NO: 1059 - RNA, 22 nt, Homo sapiens
uucuggaauucugugugaggga

SEQ ID NO: 1060 - RNA, 24 nt, Homo sapiens
uugcagcugccugggagugacuuc

SEQ ID NO: 1061 - RNA, 22 nt, Homo sapiens
uuuagagacggggucuugcucu

SEQ ID NO: 1062 - RNA, 22 nt, Homo sapiens
ucucacuguagccucgaacccc

SEQ ID NO: 1063 - RNA, 22 nt, Homo sapiens
ccaccuccccugcaaacgucca

SEQ ID NO: 1064 - RNA, 22 nt, Homo sapiens
acucggcguggcgucggucgug

SEQ ID NO: 1065 - RNA, 21 nt, Homo sapiens
ucgaccggaccucgaccggcu

SEQ ID NO: 1066 - RNA, 22 nt, Homo sapiens
cagugcaauguuaaaagggcau

SEQ ID NO: 1067 - RNA, 22 nt, Homo sapiens
cagugcaaugaugaaagggcau

SEQ ID NO: 1068 - RNA, 21 nt, Homo sapiens
acucuuucccuguugcacuac

SEQ ID NO: 1069 - RNA, 22 nt, Homo sapiens
ugugacugguugaccagagggg

SEQ ID NO: 1070 - RNA, 23 nt, Homo sapiens
acuccauuuguuuugaugaugga

SEQ ID NO: 1071 - RNA, 22 nt, Homo sapiens
gcuacuucacaacaccagggcc

SEQ ID NO: 1072 - RNA, 23 nt, Homo sapiens
ucuacagugcacgugucuccagu

SEQ ID NO: 1073 - RNA, 22 nt, Homo sapiens
cagugguuuuacccuaugguag

SEQ ID NO: 1074 - RNA, 22 nt, Homo sapiens
uaacacugucugguaaagaugg

SEQ ID NO: 1075 - RNA, 21 nt, Homo sapiens
cauaaaguagaaagcacuacu

SEQ ID NO: 1076 - RNA, 21 nt, Homo sapiens
ugagaugaagcacuguagcuc

SEQ ID NO: 1077 - RNA, 20 nt, Homo sapiens
uacaguauagaugauguacu

SEQ ID NO: 1078 - RNA, 22 nt, Homo sapiens
ggauaucaucauauacuguaag

SEQ ID NO: 1079 - RNA, 23 nt, Homo sapiens
guccaguuuucccaggaaucccu

SEQ ID NO: 1080 - RNA, 22 nt, Homo sapiens
ugagaacugaauuccauggguu

SEQ ID NO: 1081 - RNA, 22 nt, Homo sapiens
ugagaacugaauuccauaggcu

SEQ ID NO: 1082 - RNA, 22 nt, Homo sapiens
ucagugcacuacagaacuuugu

SEQ ID NO: 1083 - RNA, 22 nt, Homo sapiens
ucagugcaucacagaacuuugu

SEQ ID NO: 1084 - RNA, 21 nt, Homo sapiens
agggagggacgggggcugugc

SEQ ID NO: 1085 - RNA, 22 nt, Homo sapiens
ucucccaacccuuguaccagug

SEQ ID NO: 1086 - RNA, 21 nt, Homo sapiens
cuagacugaagcuccuugagg

SEQ ID NO: 1087 - RNA, 21 nt, Homo sapiens
ucagugcaugacagaacuugg

SEQ ID NO: 1088 - RNA, 22 nt, Homo sapiens
uagguuauccguguugccuucg

SEQ ID NO: 1089 - RNA, 23 nt, Homo sapiens
uuaaugcuaaucgugauaggggu

SEQ ID NO: 1090 - RNA, 22 nt, Homo sapiens
uagcagcacauaaugguuugug

SEQ ID NO: 1091 - RNA, 22 nt, Homo sapiens
uagcagcacaucaugguuuaca

SEQ ID NO: 1092 - RNA, 22 nt, Homo sapiens
uagcagcacguaaauauuggcg

SEQ ID NO: 1093 - RNA, 22 nt, Homo sapiens
acugcagugaaggcacuuguag

SEQ ID NO: 1094 - RNA, 23 nt, Homo sapiens
caaagugcuuacagugcagguag

SEQ ID NO: 1095 - RNA, 23 nt, Homo sapiens
aacauucaacgcugucggugagu

SEQ ID NO: 1096 - RNA, 23 nt, Homo sapiens
aacauucauugcugucggugggu

SEQ ID NO: 1097 - RNA, 22 nt, Homo sapiens
aacauucaaccugucggugagu

SEQ ID NO: 1098 - RNA, 23 nt, Homo sapiens
aacauucauuguugucggugggu

SEQ ID NO: 1099 - RNA, 22 nt, Homo sapiens
aggggcuggcuuuccucugguc

SEQ ID NO: 1100 - RNA, 22 nt, Homo sapiens
uggagagaaaggcaguuccuga

SEQ ID NO: 1101 - RNA, 22 nt, Homo sapiens
gcccaaaggugaauuuuuuggg

SEQ ID NO: 1102 - RNA, 22 nt, Homo sapiens
caaagaauucuccuuuugggcu

SEQ ID NO: 1103 - RNA, 22 nt, Homo sapiens
ucgugucuuguguugcagccgg

SEQ ID NO: 1104 - RNA, 22 nt, Homo sapiens
ggcuacaacacaggacccgggc

SEQ ID NO: 1105 - RNA, 23 nt, Homo sapiens
uaaggugcaucuagugcagauag

SEQ ID NO: 1106 - RNA, 23 nt, Homo sapiens
uaaggugcaucuagugcaguuag

SEQ ID NO: 1107 - RNA, 21 nt, Homo sapiens
cggcggggacggcgauugguc

SEQ ID NO: 1108 - RNA, 22 nt, Homo sapiens
ucugcccccuccgcugcugcca

SEQ ID NO: 1109 - RNA, 22 nt, Homo sapiens
ggaggggucccgcacugggagg

SEQ ID NO: 1110 - RNA, 22 nt, Homo sapiens
cccugugcccggcccacuucug

SEQ ID NO: 1111 - RNA, 20 nt, Homo sapiens
ccccagggcgacgcggcggg

SEQ ID NO: 1112 - RNA, 23 nt, Homo sapiens
caacggaaucccaaaagcagcug

SEQ ID NO: 1113 - RNA, 21 nt, Homo sapiens
cugaccuaugaauugacagcc

SEQ ID NO: 1114 - RNA, 22 nt, Homo sapiens
aacuggccuacaaagucccagu

SEQ ID NO: 1115 - RNA, 22 nt, Homo sapiens
ugggucuuugcgggcgagauga

SEQ ID NO: 1116 - RNA, 22 nt, Homo sapiens
aacuggcccucaaagucccgcu

SEQ ID NO: 1117 - RNA, 22 nt, Homo sapiens
uguaacagcaacuccaugugga

SEQ ID NO: 1118 - RNA, 21 nt, Homo sapiens
uagcagcacagaaauauuggc

SEQ ID NO: 1119 - RNA, 22 nt, Homo sapiens
uucaccaccuucuccacccagc

SEQ ID NO: 1120 - RNA, 23 nt, Homo sapiens
cggguagagagggcagugggagg

SEQ ID NO: 1121 - RNA, 20 nt, Homo sapiens
ccuccugcccuccuugcugu

SEQ ID NO: 1122 - RNA, 22 nt, Homo sapiens
acaguagucugcacauugguua

SEQ ID NO: 1123 - RNA, 23 nt, Homo sapiens
cccaguguucagacuaccuguuc

SEQ ID NO: 1124 - RNA, 23 nt, Homo sapiens
ugugcaaaucuaugcaaaacuga

SEQ ID NO: 1125 - RNA, 23 nt, Homo sapiens
ugugcaaauccaugcaaaacuga

SEQ ID NO: 1126 - RNA, 23 nt, Homo sapiens
ugugcaaauccaugcaaaacuga

SEQ ID NO: 1127 - RNA, 22 nt, Homo sapiens
uccuucauuccaccggagucug

SEQ ID NO: 1128 - RNA, 23 nt, Homo sapiens
uaaagugcuuauagugcagguag

SEQ ID NO: 1129 - RNA, 23 nt, Homo sapiens
caaagugcucauagugcagguag

SEQ ID NO: 1130 - RNA, 22 nt, Homo sapiens
cugugcgugugacagcggcuga

SEQ ID NO: 1131 - RNA, 22 nt, Homo sapiens
agccccugcccaccgcacacug

SEQ ID NO: 1132 - RNA, 22 nt, Homo sapiens
uuggggaaacggccgcugagug

SEQ ID NO: 1133 - RNA, 22 nt, Homo sapiens
caucagaauucauggaggcuag

SEQ ID NO: 1134 - RNA, 22 nt, Homo sapiens
agcuuccaugacuccugaugga

SEQ ID NO: 1135 - RNA, 21 nt, Homo sapiens
caacaccagucgaugggcugu

SEQ ID NO: 1136 - RNA, 22 nt, Homo sapiens
uagcuuaucagacugauguuga

SEQ ID NO: 1137 - RNA, 23 nt, Homo sapiens
agcuacauugucugcuggguuuc

SEQ ID NO: 1138 - RNA, 21 nt, Homo sapiens
agcuacaucuggcuacugggu

SEQ ID NO: 1139 - RNA, 22 nt, Homo sapiens
ugucaguuugucaaauacccca

SEQ ID NO: 1140 - RNA, 22 nt, Homo sapiens
cguguauuugacaagcugaguu

SEQ ID NO: 1141 - RNA, 22 nt, Homo sapiens
aagcugccaguugaagaacugu

SEQ ID NO: 1142 - RNA, 21 nt, Homo sapiens
caagucacuagugguuccguu

SEQ ID NO: 1143 - RNA, 22 nt, Homo sapiens
aguucuucaguggcaagcuuua

SEQ ID NO: 1144 - RNA, 20 nt, Homo sapiens
uaggaugggggugagaggug

SEQ ID NO: 1145 - RNA, 21 nt, Homo sapiens
aucacauugccagggauuucc

SEQ ID NO: 1146 - RNA, 22 nt, Homo sapiens
gggguuccuggggaugggauuu

SEQ ID NO: 1147 - RNA, 21 nt, Homo sapiens
aucacauugccagggauuacc

SEQ ID NO: 1148 - RNA, 22 nt, Homo sapiens
ugccuacugagcugaaacacag

SEQ ID NO: 1149 - RNA, 22 nt, Homo sapiens
uggcucaguucagcaggaacag

SEQ ID NO: 1150 - RNA, 22 nt, Homo sapiens
cauugcacuugucucggucuga

SEQ ID NO: 1151 - RNA, 22 nt, Homo sapiens
uucaaguaauccaggauaggcu

SEQ ID NO: 1152 - RNA, 22 nt, Homo sapiens
ccuguucuccauuacuuggcuc

SEQ ID NO: 1153 - RNA, 21 nt, Homo sapiens
uucaaguaauucaggauaggu

SEQ ID NO: 1154 - RNA, 21 nt, Homo sapiens
uucacaguggcuaaguuccgc

SEQ ID NO: 1155 - RNA, 22 nt, Homo sapiens
agggcuuagcugcuugugagca

SEQ ID NO: 1156 - RNA, 21 nt, Homo sapiens
uucacaguggcuaaguucugc

SEQ ID NO: 1157 - RNA, 22 nt, Homo sapiens
aaggagcucacagucuauugag

SEQ ID NO: 1158 - RNA, 19 nt, Homo sapiens
ggggccuggcggugggcgg

SEQ ID NO: 1159 - RNA, 22 nt, Homo sapiens
uagcaccaucugaaaucgguua

SEQ ID NO: 1160 - RNA, 23 nt, Homo sapiens
uagcaccauuugaaaucaguguu

SEQ ID NO: 1161 - RNA, 22 nt, Homo sapiens
uagcaccauuugaaaucgguua

SEQ ID NO: 1162 - RNA, 22 nt, Homo sapiens
ugaccgauuucuccugguguuc

SEQ ID NO: 1163 - RNA, 23 nt, Homo sapiens
cagugcaauaguauugucaaagc

SEQ ID NO: 1164 - RNA, 22 nt, Homo sapiens
uguaaacauccucgacuggaag

SEQ ID NO: 1165 - RNA, 22 nt, Homo sapiens
uguaaacauccuacacucagcu

SEQ ID NO: 1166 - RNA, 23 nt, Homo sapiens
uguaaacauccuacacucucagc

SEQ ID NO: 1167 - RNA, 22 nt, Homo sapiens
uguaaacauccccgacuggaag

SEQ ID NO: 1168 - RNA, 22 nt, Homo sapiens
cuuucagucggauguuuacagc

SEQ ID NO: 1169 - RNA, 22 nt, Homo sapiens
uguaaacauccuugacuggaag

SEQ ID NO: 1170 - RNA, 22 nt, Homo sapiens
ugccuaggcugagacugcagug

SEQ ID NO: 1171 - RNA, 22 nt, Homo sapiens
agcuuuugggaauucagguagu

SEQ ID NO: 1172 - RNA, 21 nt, Homo sapiens
accugaauuaccaaaagcuuu

SEQ ID NO: 1173 - RNA, 19 nt, Homo sapiens
gagggcggguggaggagga

SEQ ID NO: 1174 - RNA, 22 nt, Homo sapiens
uucagccaggcuagugcagucu

SEQ ID NO: 1175 - RNA, 23 nt, Homo sapiens
uuagggaguagaaggguggggag

SEQ ID NO: 1176 - RNA, 22 nt, Homo sapiens
uggggcggagcuuccggaggcc

SEQ ID NO: 1177 - RNA, 23 nt, Homo sapiens
ggaggcgcaggcucggaaaggcg

SEQ ID NO: 1178 - RNA, 22 nt, Homo sapiens
aaaagcuggguugagagggcga

SEQ ID NO: 1179 - RNA, 22 nt, Homo sapiens
aaaagcuggguugagagggcaa

SEQ ID NO: 1180 - RNA, 20 nt, Homo sapiens
aaaagcuggguugagagggu

SEQ ID NO: 1181 - RNA, 19 nt, Homo sapiens
aaaagcuggguugagagga

SEQ ID NO: 1182 - RNA, 18 nt, Homo sapiens
aaagcuggguugagaagg

SEQ ID NO: 1183 - RNA, 20 nt, Homo sapiens
acugccccaggugcugcugg

SEQ ID NO: 1184 - RNA, 23 nt, Homo sapiens
cgcauccccuagggcauuggugu

SEQ ID NO: 1185 - RNA, 20 nt, Homo sapiens
ccucugggcccuuccuccag

SEQ ID NO: 1186 - RNA, 22 nt, Homo sapiens
cuggcccucucugcccuuccgu

SEQ ID NO: 1187 - RNA, 22 nt, Homo sapiens
aacacaccugguuaaccucuuu

SEQ ID NO: 1188 - RNA, 21 nt, Homo sapiens
gccccugggccuauccuagaa

SEQ ID NO: 1189 - RNA, 23 nt, Homo sapiens
ucaagagcaauaacgaaaaaugu

SEQ ID NO: 1190 - RNA, 21 nt, Homo sapiens
gaacggcuucauacaggaguu

SEQ ID NO: 1191 - RNA, 22 nt, Homo sapiens
uccagcaucagugauuuuguug

SEQ ID NO: 1192 - RNA, 23 nt, Homo sapiens
ugagcgccucgacgacagagccg

SEQ ID NO: 1193 - RNA, 23 nt, Homo sapiens
ucccuguccuccaggagcucacg

SEQ ID NO: 1194 - RNA, 21 nt, Homo sapiens
gugcauuguaguugcauugca

SEQ ID NO: 1195 - RNA, 20 nt, Homo sapiens
gugcauugcuguugcauugc

SEQ ID NO: 1196 - RNA, 23 nt, Homo sapiens
ucucacacagaaaucgcacccgu

SEQ ID NO: 1197 - RNA, 22 nt, Homo sapiens
gcugacuccuaguccagggcuc

SEQ ID NO: 1198 - RNA, 22 nt, Homo sapiens
uggcagugucuuagcugguugu

SEQ ID NO: 1199 - RNA, 22 nt, Homo sapiens
caaucacuaacuccacugccau

SEQ ID NO: 1200 - RNA, 23 nt, Homo sapiens
ucccccaggugugauucugauuu

SEQ ID NO: 1201 - RNA, 22 nt, Homo sapiens
uuaucagaaucuccagggguac

SEQ ID NO: 1202 - RNA, 24 nt, Homo sapiens
aauccuuggaaccuaggugugagu

SEQ ID NO: 1203 - RNA, 22 nt, Homo sapiens
aauugcacgguauccaucugua

SEQ ID NO: 1204 - RNA, 21 nt, Homo sapiens
agccgcggggaucgccgaggg

SEQ ID NO: 1205 - RNA, 18 nt, Homo sapiens
cggcuggaggugugagga

SEQ ID NO: 1206 - RNA, 21 nt, Homo sapiens
gcuggucugcguggugcucgg

SEQ ID NO: 1207 - RNA, 22 nt, Homo sapiens
auuguagaaccuaagauuggcc

SEQ ID NO: 1208 - RNA, 24 nt, Homo sapiens
cccggacaggcguucgugcgacgu

SEQ ID NO: 1209 - RNA, 22 nt, Homo sapiens
gccugcugggguggaaccuggu

SEQ ID NO: 1210 - RNA, 22 nt, Homo sapiens
auauaauacaaccugcuaagug

SEQ ID NO: 1211 - RNA, 22 nt, Homo sapiens
uuuguucguucggcucgcguga

SEQ ID NO: 1212 - RNA, 21 nt, Homo sapiens
aucauagaggaaaauccacgu

SEQ ID NO: 1213 - RNA, 21 nt, Homo sapiens
aacauagaggaaauuccacgu

SEQ ID NO: 1214 - RNA, 22 nt, Homo sapiens
aucacacaaaggcaacuuuugu

SEQ ID NO: 1215 - RNA, 22 nt, Homo sapiens
acuggacuuggagucagaaggc

SEQ ID NO: 1216 - RNA, 20 nt, Homo sapiens
acuggacuuggagucagaaa

SEQ ID NO: 1217 - RNA, 20 nt, Homo sapiens
acuggacuuggagccagaag

SEQ ID NO: 1218 - RNA, 20 nt, Homo sapiens
acugggcuuggagucagaag

SEQ ID NO: 1219 - RNA, 21 nt, Homo sapiens
acuggacuaggagucagaagg

SEQ ID NO: 1220 - RNA, 22 nt, Homo sapiens
uauacaagggcaagcucucugu

SEQ ID NO: 1221 - RNA, 22 nt, Homo sapiens
gaaguuguucgugguggauucg

SEQ ID NO: 1222 - RNA, 21 nt, Homo sapiens
uaacgcauaauauggacaugu

SEQ ID NO: 1223 - RNA, 21 nt, Homo sapiens
auguccauauuauggguuagu

SEQ ID NO: 1224 - RNA, 23 nt, Homo sapiens
acaggcggcuguagcaauggggg

SEQ ID NO: 1225 - RNA, 20 nt, Homo sapiens
guggguuggggcgggcucug

SEQ ID NO: 1226 - RNA, 22 nt, Homo sapiens
gaauguugcucggugaaccccu

SEQ ID NO: 1227 - RNA, 21 nt, Homo sapiens
aauauaacacagauggccugu

SEQ ID NO: 1228 - RNA, 21 nt, Homo sapiens
caaaacgugaggcgcugcuau

SEQ ID NO: 1229 - RNA, 22 nt, Homo sapiens
aucgggaaugucguguccgccc

SEQ ID NO: 1230 - RNA, 23 nt, Homo sapiens
aaugacacgaucacucccguuga

SEQ ID NO: 1231 - RNA, 18 nt, Homo sapiens
ccagagguggggacugag

SEQ ID NO: 1232 - RNA, 20 nt, Homo sapiens
ucagggagucaggggagggc

SEQ ID NO: 1233 - RNA, 18 nt, Homo sapiens
cagcagucccucccccug

SEQ ID NO: 1234 - RNA, 16 nt, Homo sapiens
cucuccucccggcuuc

SEQ ID NO: 1235 - RNA, 16 nt, Homo sapiens
uucagcaggaacagcu

SEQ ID NO: 1236 - RNA, 18 nt, Homo sapiens
ccccugggccggccuugg

SEQ ID NO: 1237 - RNA, 17 nt, Homo sapiens
uggagagaaaggcagua

SEQ ID NO: 1238 - RNA, 21 nt, Homo sapiens
ugucuugcaggccgucaugca

SEQ ID NO: 1239 - RNA, 23 nt, Homo sapiens
ucuuggaguaggucauugggugg

SEQ ID NO: 1240 - RNA, 18 nt, Homo sapiens
ggugggcuucccggaggg

SEQ ID NO: 1241 - RNA, 20 nt, Homo sapiens
aaaagcugggcugagaggcg

SEQ ID NO: 1242 - RNA, 18 nt, Homo sapiens
aggcuggagugagcggag

SEQ ID NO: 1243 - RNA, 21 nt, Homo sapiens
augucccacccccacuccugu

SEQ ID NO: 1244 - RNA, 17 nt, Homo sapiens
gccggacaagagggagg

SEQ ID NO: 1245 - RNA, 22 nt, Homo sapiens
cgucccggggcugcgcgaggca

SEQ ID NO: 1246 - RNA, 22 nt, Homo sapiens
ccaggaggcggaggagguggag

SEQ ID NO: 1247 - RNA, 23 nt, Homo sapiens
gauugagacuaguagggcuaggc

SEQ ID NO: 1248 - RNA, 17 nt, Homo sapiens
gagacugggguggggcc

SEQ ID NO: 1249 - RNA, 17 nt, Homo sapiens
gaggcugagcugaggag

SEQ ID NO: 1250 - RNA, 17 nt, Homo sapiens
ggagugggcuggugguu

SEQ ID NO: 1251 - RNA, 20 nt, Homo sapiens
aaaaggcgggagaagcccca

SEQ ID NO: 1252 - RNA, 17 nt, Homo sapiens
gcugggcgaggcuggca

SEQ ID NO: 1253 - RNA, 22 nt, Homo sapiens
gaggaaacugaagcugagaggg

SEQ ID NO: 1254 - RNA, 18 nt, Homo sapiens
aggcugggcugggacgga

SEQ ID NO: 1255 - RNA, 20 nt, Homo sapiens
cuggguugggcugggcuggg

SEQ ID NO: 1256 - RNA, 22 nt, Homo sapiens
aaaccguuaccauuacugaguu

SEQ ID NO: 1257 - RNA, 18 nt, Homo sapiens
cccagcaggacgggagcg

SEQ ID NO: 1258 - RNA, 17 nt, Homo sapiens
ggauggaggaggggucu

SEQ ID NO: 1259 - RNA, 22 nt, Homo sapiens
gcugaacugggcugagcugggc

SEQ ID NO: 1260 - RNA, 23 nt, Homo sapiens
uagugcaauauugcuuauagggu

SEQ ID NO: 1261 - RNA, 23 nt, Homo sapiens
gagggcagcguggguguggcgga

SEQ ID NO: 1262 - RNA, 22 nt, Homo sapiens
acugggaagaggagcugaggga

SEQ ID NO: 1263 - RNA, 21 nt, Homo sapiens
acccucgucagguccccgggg

SEQ ID NO: 1264 - RNA, 22 nt, Homo sapiens
caccggggauggcagagggucg

SEQ ID NO: 1265 - RNA, 23 nt, Homo sapiens
ugggcugagggcaggaggccugu

SEQ ID NO: 1266 - RNA, 22 nt, Homo sapiens
acuggggagcagaaggagaacc

SEQ ID NO: 1267 - RNA, 22 nt, Homo sapiens
gagcaggcgaggcugggcugaa

SEQ ID NO: 1268 - RNA, 22 nt, Homo sapiens
caggaggcagugggcgagcagg

SEQ ID NO: 1269 - RNA, 25 nt, Homo sapiens
agcggggaggaagugggcgcugcuu

SEQ ID NO: 1270 - RNA, 22 nt, Homo sapiens
agcccgccccagccgagguucu

SEQ ID NO: 1271 - RNA, 23 nt, Homo sapiens
agggccagaggagccuggagugg

SEQ ID NO: 1272 - RNA, 23 nt, Homo sapiens
ugggaggggagaggcagcaagca

SEQ ID NO: 1273 - RNA, 22 nt, Homo sapiens
gcugcgggcugcggucagggcg

SEQ ID NO: 1274 - RNA, 23 nt, Homo sapiens
gugagugggagccgguggggcug

SEQ ID NO: 1275 - RNA, 24 nt, Homo sapiens
aggcaggggcuggugcugggcggg

SEQ ID NO: 1276 - RNA, 20 nt, Homo sapiens
ugaggagaugcugggacuga

SEQ ID NO: 1277 - RNA, 24 nt, Homo sapiens
acauccugcuccacagggcagagg

SEQ ID NO: 1278 - RNA, 19 nt, Homo sapiens
cauccguccgucuguccac

SEQ ID NO: 1279 - RNA, 21 nt, Homo sapiens
aguggaccgaggaaggaagga

SEQ ID NO: 1280 - RNA, 22 nt, Homo sapiens
ucaggcucaguccccucccgau

SEQ ID NO: 1281 - RNA, 22 nt, Homo sapiens
gucauacacggcucuccucucu

SEQ ID NO: 1282 - RNA, 22 nt, Homo sapiens
uccuguacugagcugccccgag

SEQ ID NO: 1283 - RNA, 22 nt, Homo sapiens
aaucguacagggucauccacuu

SEQ ID NO: 1284 - RNA, 22 nt, Homo sapiens
aguggggaacccuuccaugagg

SEQ ID NO: 1285 - RNA, 22 nt, Homo sapiens
ugaaacauacacgggaaaccuc

SEQ ID NO: 1286 - RNA, 22 nt, Homo sapiens
aaacaaacauggugcacuucuu

SEQ ID NO: 1287 - RNA, 24 nt, Homo sapiens
agggcuggacucagcggcggagcu

SEQ ID NO: 1288 - RNA, 21 nt, Homo sapiens
uugccagggcaggagguggaa

SEQ ID NO: 1289 - RNA, 22 nt, Homo sapiens
aaugcaccugggcaaggauuca

SEQ ID NO: 1290 - RNA, 21 nt, Homo sapiens
gggagugcagggcaggguuuc

SEQ ID NO: 1291 - RNA, 22 nt, Homo sapiens
cgucaacacuugcugguuuccu

SEQ ID NO: 1292 - RNA, 22 nt, Homo sapiens
agggaaggggacgaggguuggg

SEQ ID NO: 1293 - RNA, 22 nt, Homo sapiens
ccucccacacccaaggcuugca

SEQ ID NO: 1294 - RNA, 22 nt, Homo sapiens
caugccuugaguguaggaccgu

SEQ ID NO: 1295 - RNA, 22 nt, Homo sapiens
uggugggcacagaaucuggacu

SEQ ID NO: 1296 - RNA, 22 nt, Homo sapiens
aaacauucgcggugcacuucuu

SEQ ID NO: 1297 - RNA, 21 nt, Homo sapiens
aaaaguaacugcgguuuuuga

SEQ ID NO: 1298 - RNA, 22 nt, Homo sapiens
aaaaguaauugugguuuuugcc

SEQ ID NO: 1299 - RNA, 21 nt, Homo sapiens
gcgacccauacuugguuucag

SEQ ID NO: 1300 - RNA, 22 nt, Homo sapiens
cugaauagcugggacuacaggu

SEQ ID NO: 1301 - RNA, 21 nt, Homo sapiens
gccccgggcagugugaucauc

SEQ ID NO: 1302 - RNA, 22 nt, Homo sapiens
caaaguuuaagauccuugaagu

SEQ ID NO: 1303 - RNA, 19 nt, Homo sapiens
gggcgccugugaucccaac

SEQ ID NO: 1304 - RNA, 21 nt, Homo sapiens
cagaucaugggacugucucag

SEQ ID NO: 1305 - RNA, 18 nt, Homo sapiens
aggagaagucgggaaggu

SEQ ID NO: 1306 - RNA, 20 nt, Homo sapiens
gcggagagagaauggggagc

SEQ ID NO: 1307 - RNA, 22 nt, Homo sapiens
cacgcucaugcacacacccaca

SEQ ID NO: 1308 - RNA, 23 nt, Homo sapiens
ugagugugugugugugagugugu

SEQ ID NO: 1309 - RNA, 22 nt, Homo sapiens
uuaugguuugccugggacugag

SEQ ID NO: 1310 - RNA, 22 nt, Homo sapiens
gagcuuauucauaaaagugcag

SEQ ID NO: 1311 - RNA, 21 nt, Homo sapiens
gggcuagggccugcugccccc

SEQ ID NO: 1312 - RNA, 19 nt, Homo sapiens
aaggggcugggggagcaca

SEQ ID NO: 1313 - RNA, 20 nt, Homo sapiens
ggagguugggaagggcagag

SEQ ID NO: 1314 - RNA, 20 nt, Homo sapiens
agagaugaagcgggggggcg

SEQ ID NO: 1315 - RNA, 25 nt, Homo sapiens
gcugggcagggcuucugagcuccuu

SEQ ID NO: 1316 - RNA, 20 nt, Homo sapiens
gggaaaaggaagggggagga

SEQ ID NO: 1317 - RNA, 18 nt, Homo sapiens
gugaaggcccggcggaga

SEQ ID NO: 1318 - RNA, 19 nt, Homo sapiens
ugagggagugggugggagg

SEQ ID NO: 1319 - RNA, 19 nt, Homo sapiens
ggcuggucagaugggagug

SEQ ID NO: 1320 - RNA, 19 nt, Homo sapiens
cagcaggaggugaggggag

SEQ ID NO: 1321 - RNA, 21 nt, Homo sapiens
agggggaaaguucuauagucc

SEQ ID NO: 1322 - RNA, 21 nt, Homo sapiens
uggguuuacguugggagaacu

SEQ ID NO: 1323 - RNA, 23 nt, Homo sapiens
ccucaccaccccuucugccugca

SEQ ID NO: 1324 - RNA, 21 nt, Homo sapiens
aauggcgccacuaggguugug

SEQ ID NO: 1325 - RNA, 22 nt, Homo sapiens
uggugggccgcagaacaugugc

SEQ ID NO: 1326 - RNA, 25 nt, Homo sapiens
ggcggagggaaguagguccguuggu

SEQ ID NO: 1327 - RNA, 22 nt, Homo sapiens
uacccauugcauaucggaguug

SEQ ID NO: 1328 - RNA, 22 nt, Homo sapiens
gguggcccggccgugccugagg

SEQ ID NO: 1329 - RNA, 23 nt, Homo sapiens
uauucauuuauccccagccuaca

SEQ ID NO: 1330 - RNA, 24 nt, Homo sapiens
ugggcuaagggagaugauugggua

SEQ ID NO: 1331 - RNA, 23 nt, Homo sapiens
aggaagcccuggaggggcuggag

SEQ ID NO: 1332 - RNA, 20 nt, Homo sapiens
ugggaauggggguaagggcc

SEQ ID NO: 1333 - RNA, 22 nt, Homo sapiens
auaguccgaguaacgucggggc

SEQ ID NO: 1334 - RNA, 21 nt, Homo sapiens
cgggagcuggggucugcaggu

SEQ ID NO: 1335 - RNA, 23 nt, Homo sapiens
cucggggcaggcggcugggagcg

SEQ ID NO: 1336 - RNA, 21 nt, Homo sapiens
ucaucccccucgcccucucag

SEQ ID NO: 1337 - RNA, 23 nt, Homo sapiens
cgagggguagaagagcacagggg

SEQ ID NO: 1338 - RNA, 22 nt, Homo sapiens
ucggcucucucccucacccuag

SEQ ID NO: 1339 - RNA, 22 nt, Homo sapiens
gugggugcuggugggagccgug

SEQ ID NO: 1340 - RNA, 22 nt, Homo sapiens
aguggggugggacccagcuguu

SEQ ID NO: 1341 - RNA, 22 nt, Homo sapiens
ccgggagaaggagguggccugg

SEQ ID NO: 1342 - RNA, 23 nt, Homo sapiens
aggguggggcuggagguggggcu

SEQ ID NO: 1343 - RNA, 25 nt, Homo sapiens
gugaggcggggccaggagggugugu

SEQ ID NO: 1344 - RNA, 21 nt, Homo sapiens
agguggguauggaggagcccu

SEQ ID NO: 1345 - RNA, 21 nt, Homo sapiens
cccucucugucccacccauag

SEQ ID NO: 1346 - RNA, 21 nt, Homo sapiens
caaaccccugucuacccgcag

SEQ ID NO: 1347 - RNA, 22 nt, Homo sapiens
cucgggagggcaugggccaggc

SEQ ID NO: 1348 - RNA, 21 nt, Homo sapiens
aggcccuguccucugccccag

SEQ ID NO: 1349 - RNA, 25 nt, Homo sapiens
ucggggcaugggggagggaggcugg

SEQ ID NO: 1350 - RNA, 22 nt, Homo sapiens
agugggaggacaggaggcaggu

SEQ ID NO: 1351 - RNA, 23 nt, Homo sapiens
uggggaaggcuuggcagggaaga

SEQ ID NO: 1352 - RNA, 21 nt, Homo sapiens
cgggccggaggucaagggcgu

SEQ ID NO: 1353 - RNA, 25 nt, Homo sapiens
uaggggugggggaauucaggggugu

SEQ ID NO: 1354 - RNA, 21 nt, Homo sapiens
acaucgccccaccuuccccag

SEQ ID NO: 1355 - RNA, 24 nt, Homo sapiens
guaggggcgucccgggcgcgcggg

SEQ ID NO: 1356 - RNA, 22 nt, Homo sapiens
ccccuggggcugggcaggcgga

SEQ ID NO: 1357 - RNA, 20 nt, Homo sapiens
cagggggacugggggugagc

SEQ ID NO: 1358 - RNA, 21 nt, Homo sapiens
accccucguuucuucccccag

SEQ ID NO: 1359 - RNA, 21 nt, Homo sapiens
gaagcucuccccuccccgcag

SEQ ID NO: 1360 - RNA, 25 nt, Homo sapiens
aggagggaaggggcugagaacagga

SEQ ID NO: 1361 - RNA, 23 nt, Homo sapiens
ccagggggaugggcgagcuuggg

SEQ ID NO: 1362 - RNA, 20 nt, Homo sapiens
ggggaggugugcagggcugg

SEQ ID NO: 1363 - RNA, 20 nt, Homo sapiens
cuagguggggggcuugaagc

SEQ ID NO: 1364 - RNA, 22 nt, Homo sapiens
ucccucgccuucucacccucag

SEQ ID NO: 1365 - RNA, 22 nt, Homo sapiens
cuggggguggggggcugggcgu

SEQ ID NO: 1366 - RNA, 22 nt, Homo sapiens
uggcaaggaaagaagaggauca

SEQ ID NO: 1367 - RNA, 23 nt, Homo sapiens
uccccugcucccuuguuccccag

SEQ ID NO: 1368 - RNA, 25 nt, Homo sapiens
auggggugagauggggaggagcagc

SEQ ID NO: 1369 - RNA, 21 nt, Homo sapiens
aaccuuggccccucuccccag

SEQ ID NO: 1370 - RNA, 21 nt, Homo sapiens
aagccucuguccccaccccag

SEQ ID NO: 1371 - RNA, 23 nt, Homo sapiens
gugcgugguggcucgaggcgggg

SEQ ID NO: 1372 - RNA, 22 nt, Homo sapiens
guaggggagguugggccaggga

SEQ ID NO: 1373 - RNA, 20 nt, Homo sapiens
ugggcugcugagaaggggca

SEQ ID NO: 1374 - RNA, 19 nt, Homo sapiens
cggggccagagcagagagc

SEQ ID NO: 1375 - RNA, 17 nt, Homo sapiens
uguccucuguuccucag

SEQ ID NO: 1376 - RNA, 21 nt, Homo sapiens
cccugggguucugaggacaug

SEQ ID NO: 1377 - RNA, 22 nt, Homo sapiens
gugaguaguggcgcgcggcggc

SEQ ID NO: 1378 - RNA, 22 nt, Homo sapiens
gcucauccccaucuccuuucag

SEQ ID NO: 1379 - RNA, 19 nt, Homo sapiens
ugggggagauggggguuga

SEQ ID NO: 1380 - RNA, 23 nt, Homo sapiens
uucucucugucuuucucucucag

SEQ ID NO: 1381 - RNA, 21 nt, Homo sapiens
ugagggacccaggacaggaga

SEQ ID NO: 1382 - RNA, 22 nt, Homo sapiens
agggccgaaggguggaagcugc

SEQ ID NO: 1383 - RNA, 22 nt, Homo sapiens
ugguggaggaagagggcagcuc

SEQ ID NO: 1384 - RNA, 21 nt, Homo sapiens
ucccucucccaccccuugcag

SEQ ID NO: 1385 - RNA, 24 nt, Homo sapiens
aggaggauggagagcugggccaga

SEQ ID NO: 1386 - RNA, 20 nt, Homo sapiens
ugggaggaggggaucuuggg

SEQ ID NO: 1387 - RNA, 22 nt, Homo sapiens
ucggccuggggaggaggaaggg

SEQ ID NO: 1388 - RNA, 21 nt, Homo sapiens
guguggccggcaggcgggugg

SEQ ID NO: 1389 - RNA, 22 nt, Homo sapiens
ugggggaggaaggacaggccau

SEQ ID NO: 1390 - RNA, 21 nt, Homo sapiens
ugacccaccccucuccaccag

SEQ ID NO: 1391 - RNA, 18 nt, Homo sapiens
cuggcagggggagaggua

SEQ ID NO: 1392 - RNA, 22 nt, Homo sapiens
ugcggggcuagggcuaacagca

SEQ ID NO: 1393 - RNA, 22 nt, Homo sapiens
gcaggugcucacuuguccuccu

SEQ ID NO: 1394 - RNA, 21 nt, Homo sapiens
uggaggagaaggaaggugaug

SEQ ID NO: 1395 - RNA, 22 nt, Homo sapiens
acuccagccccacagccucagc

SEQ ID NO: 1396 - RNA, 22 nt, Homo sapiens
aggaggaauuggugcuggucuu

SEQ ID NO: 1397 - RNA, 22 nt, Homo sapiens
ugagaccucuggguucugagcu

SEQ ID NO: 1398 - RNA, 21 nt, Homo sapiens
aagggacagggagggucgugg

SEQ ID NO: 1399 - RNA, 22 nt, Homo sapiens
uaccugggagacugagguugga

SEQ ID NO: 1400 - RNA, 23 nt, Homo sapiens
ggaugguugggggcggucggcgu

SEQ ID NO: 1401 - RNA, 20 nt, Homo sapiens
cgguggacuggagugggugg

SEQ ID NO: 1402 - RNA, 23 nt, Homo sapiens
ggucuaggcccggugagagacuc

SEQ ID NO: 1403 - RNA, 21 nt, Homo sapiens
ugggagagaggacugugaggc

SEQ ID NO: 1404 - RNA, 24 nt, Homo sapiens
ccuggggacaggggauuggggcag

SEQ ID NO: 1405 - RNA, 22 nt, Homo sapiens
cugcccuggcccgagggaccga

SEQ ID NO: 1406 - RNA, 21 nt, Homo sapiens
uccucuucucccuccucccag

SEQ ID NO: 1407 - RNA, 20 nt, Homo sapiens
guagaggagauggcgcaggg

SEQ ID NO: 1408 - RNA, 20 nt, Homo sapiens
ggggagcuguggaagcagua

SEQ ID NO: 1409 - RNA, 22 nt, Homo sapiens
uauugcacuugucccggccugu

SEQ ID NO: 1410 - RNA, 22 nt, Homo sapiens
uauugcacucgucccggccucc

SEQ ID NO: 1411 - RNA, 22 nt, Homo sapiens
acugcugagcuagcacuucccg

SEQ ID NO: 1412 - RNA, 23 nt, Homo sapiens
caaagugcuguucgugcagguag

SEQ ID NO: 1413 - RNA, 22 nt, Homo sapiens
aacccguagauccgaucuugug

SEQ ID NO: 1414 - RNA, 22 nt, Homo sapiens
cacccguagaaccgaccuugcg
